US012391762B2

(12) United States Patent
Sato et al.

(10) Patent No.: US 12,391,762 B2
(45) Date of Patent: Aug. 19, 2025

(54) METHODS AND COMPOSITIONS RELATING TO GLP1R VARIANTS

(71) Applicant: Twist Bioscience Corporation, South San Francisco, CA (US)

(72) Inventors: Aaron Sato, Burlingame, CA (US); Pankaj Garg, Burlingame, CA (US); Qiang Liu, Palo Alto, CA (US); Fumiko Axelrod, Palo Alto, CA (US)

(73) Assignee: Twist Bioscience Corporation, South San Francisco, CA (US)

( * ) Notice: Subject to any disclaimer, the term of this patent is extended or adjusted under 35 U.S.C. 154(b) by 431 days.

(21) Appl. No.: 17/412,139

(22) Filed: Aug. 25, 2021

(65) Prior Publication Data

US 2022/0064313 A1 Mar. 3, 2022

Related U.S. Application Data

(60) Provisional application No. 63/081,801, filed on Sep. 22, 2020, provisional application No. 63/070,734, filed on Aug. 26, 2020.

(51) Int. Cl.
*C07K 16/28* (2006.01)

(52) U.S. Cl.
CPC ...... *C07K 16/2869* (2013.01); *C07K 2317/24* (2013.01); *C07K 2317/565* (2013.01); *C07K 2317/75* (2013.01); *C07K 2317/76* (2013.01); *C07K 2317/92* (2013.01)

(58) Field of Classification Search
CPC ............ C07K 16/2869; C07K 2317/24; C07K 2317/565; C07K 2317/75; C07K 2317/76; C07K 2317/92
See application file for complete search history.

(56) References Cited

U.S. PATENT DOCUMENTS

| | | | |
|---|---|---|---|
| 5,368,823 A | 11/1994 | McGraw et al. | |
| 5,474,796 A | 12/1995 | Brennan | |
| 5,534,507 A | 7/1996 | Cama et al. | |
| 5,677,195 A | 10/1997 | Winkler et al. | |
| 5,843,767 A | 12/1998 | Beattie | |
| 6,013,440 A | 1/2000 | Lipshutz et al. | |
| 6,028,189 A | 2/2000 | Blanchard | |
| 6,419,883 B1 | 7/2002 | Blanchard | |
| 6,472,147 B1 | 10/2002 | Janda et al. | |
| 6,492,107 B1 | 12/2002 | Kauffman et al. | |
| 6,709,841 B2 | 3/2004 | Short | |
| 6,893,816 B1 | 5/2005 | Beattie | |
| 7,163,660 B2 | 1/2007 | Lehmann | |
| 7,202,264 B2 | 4/2007 | Ravikumar et al. | |
| 7,947,809 B2 * | 5/2011 | Yan | C07K 14/723 530/387.3 |
| 8,198,071 B2 | 6/2012 | Goshoo et al. | |
| 9,403,141 B2 | 8/2016 | Banyai et al. | |
| 9,409,139 B2 | 8/2016 | Banyai et al. | |
| 9,555,388 B2 | 1/2017 | Banyai et al. | |
| 9,677,067 B2 | 6/2017 | Toro et al. | |
| 9,745,619 B2 | 8/2017 | Rabbani et al. | |
| 9,765,387 B2 | 9/2017 | Rabbani et al. | |
| 9,833,761 B2 | 12/2017 | Banyai et al. | |
| 9,839,894 B2 | 12/2017 | Banyai et al. | |
| 9,889,423 B2 | 2/2018 | Banyai et al. | |
| 9,895,673 B2 | 2/2018 | Peck et al. | |
| 9,981,239 B2 | 5/2018 | Banyai et al. | |
| 10,053,688 B2 | 8/2018 | Cox | |
| 10,272,410 B2 | 4/2019 | Banyai et al. | |
| 10,384,188 B2 | 8/2019 | Banyai et al. | |
| 10,384,189 B2 | 8/2019 | Peck | |
| 10,417,457 B2 | 9/2019 | Peck | |
| 10,583,415 B2 | 3/2020 | Banyai et al. | |
| 10,618,024 B2 | 4/2020 | Banyai et al. | |
| 10,632,445 B2 | 4/2020 | Banyai et al. | |
| 10,639,609 B2 | 5/2020 | Banyai et al. | |
| 10,669,304 B2 | 6/2020 | Indermuhle et al. | |
| 10,744,477 B2 | 8/2020 | Banyai et al. | |
| 10,754,994 B2 | 8/2020 | Peck | |
| 10,773,232 B2 | 9/2020 | Banyai et al. | |
| 10,844,373 B2 | 11/2020 | Cox et al. | |
| 10,894,242 B2 | 1/2021 | Marsh et al. | |
| 10,894,959 B2 | 1/2021 | Cox et al. | |
| 10,907,274 B2 | 2/2021 | Cox | |
| 10,936,953 B2 | 3/2021 | Bramlett et al. | |
| 10,969,965 B2 | 4/2021 | Malina et al. | |
| 10,975,372 B2 | 4/2021 | Cox et al. | |
| 10,987,648 B2 | 4/2021 | Peck et al. | |
| 11,214,798 B2 | 1/2022 | Brown | |
| 11,407,837 B2 | 8/2022 | Glanville | |
| 11,562,103 B2 | 1/2023 | Peck | |
| 11,884,736 B2 | 1/2024 | Okamoto et al. | |

(Continued)

FOREIGN PATENT DOCUMENTS

| | | |
|---|---|---|
| CN | 101277758 A | 10/2008 |
| EP | 3030682 A2 | 6/2016 |

(Continued)

OTHER PUBLICATIONS

Lazar et al. Transforming Growth Factor alpha: Mutation of Aspartic Acid 47 and Leucine 48 Results in Different Biological Activities. Mol. Cell. Biol., 8:1247-1252, 1988 (Year: 1988).*

(Continued)

*Primary Examiner* — Vansessa L. Ford
*Assistant Examiner* — Danaya L Middleton
(74) *Attorney, Agent, or Firm* — McNeill PLLC

(57) ABSTRACT

Provided herein are methods and compositions relating to glucagon-like peptide-1 receptor (GLP1R) libraries having nucleic acids encoding for immunoglobulins that bind to GLP1R. Libraries described herein include variegated libraries comprising nucleic acids each encoding for a predetermined variant of at least one predetermined reference nucleic acid sequence. Further described herein are protein libraries generated when the nucleic acid libraries are translated. Further described herein are cell libraries expressing variegated nucleic acid libraries described herein.

16 Claims, 29 Drawing Sheets

Specification includes a Sequence Listing.

(56) References Cited

U.S. PATENT DOCUMENTS

| | | | |
|---|---|---|---|
| 2001/0018512 | A1 | 8/2001 | Blanchard |
| 2002/0025561 | A1 | 2/2002 | Hodgson |
| 2002/0094533 | A1 | 7/2002 | Hess et al. |
| 2002/0095073 | A1 | 7/2002 | Jacobs et al. |
| 2002/0160536 | A1 | 10/2002 | Regnier et al. |
| 2002/0164824 | A1 | 11/2002 | Xiao et al. |
| 2003/0120035 | A1 | 6/2003 | Gao et al. |
| 2003/0171325 | A1 | 9/2003 | Gascoyne et al. |
| 2004/0087008 | A1 | 5/2004 | Schembri |
| 2004/0259146 | A1 | 12/2004 | Friend et al. |
| 2005/0049402 | A1 | 3/2005 | Babcook et al. |
| 2005/0137805 | A1 | 6/2005 | Lewin et al. |
| 2005/0227235 | A1 | 10/2005 | Carr et al. |
| 2006/0127920 | A1 | 6/2006 | Church et al. |
| 2007/0196834 | A1 | 8/2007 | Cerrina et al. |
| 2008/0085511 | A1 | 4/2008 | Peck et al. |
| 2008/0085514 | A1 | 4/2008 | Peck et al. |
| 2008/0227160 | A1 | 9/2008 | Kool |
| 2008/0287320 | A1 | 11/2008 | Baynes et al. |
| 2008/0300842 | A1 | 12/2008 | Govindarajan et al. |
| 2009/0062129 | A1 | 3/2009 | McKernan et al. |
| 2009/0239759 | A1 | 9/2009 | Balch |
| 2009/0285825 | A1 | 11/2009 | Kini et al. |
| 2010/0004143 | A1 | 1/2010 | Shibahara |
| 2010/0099103 | A1 | 4/2010 | Hsieh et al. |
| 2010/0111768 | A1 | 5/2010 | Banerjee et al. |
| 2010/0216648 | A1 | 8/2010 | Staehler et al. |
| 2010/0311960 | A1 | 12/2010 | Dellinger |
| 2011/0172127 | A1 | 7/2011 | Jacobson et al. |
| 2011/0217738 | A1 | 9/2011 | Jacobson |
| 2012/0129704 | A1 | 5/2012 | Gunderson et al. |
| 2012/0164691 | A1 | 6/2012 | Eshoo et al. |
| 2012/0231968 | A1 | 9/2012 | Bruhn et al. |
| 2012/0264653 | A1 | 10/2012 | Carr et al. |
| 2013/0017642 | A1 | 1/2013 | Milgrew et al. |
| 2013/0017977 | A1 | 1/2013 | Oleinikov |
| 2013/0065017 | A1 | 3/2013 | Sieber |
| 2013/0109595 | A1 | 5/2013 | Routenberg |
| 2013/0109596 | A1 | 5/2013 | Peterson et al. |
| 2013/0130321 | A1 | 5/2013 | Staehler et al. |
| 2013/0164308 | A1 | 6/2013 | Foletti et al. |
| 2013/0165328 | A1 | 6/2013 | Previte et al. |
| 2014/0106394 | A1 | 4/2014 | Ko et al. |
| 2014/0178992 | A1 | 6/2014 | Nakashima et al. |
| 2015/0038373 | A1 | 2/2015 | Banyai et al. |
| 2015/0120265 | A1 | 4/2015 | Amirav-Drory et al. |
| 2015/0196917 | A1 | 7/2015 | Kay et al. |
| 2016/0089651 | A1 | 3/2016 | Banyai |
| 2016/0090592 | A1 | 3/2016 | Banyai et al. |
| 2016/0096160 | A1 | 4/2016 | Banyai et al. |
| 2016/0251651 | A1 | 9/2016 | Banyai et al. |
| 2016/0297883 | A1 | 10/2016 | Gallo et al. |
| 2016/0303535 | A1 | 10/2016 | Banyai et al. |
| 2016/0333340 | A1 | 11/2016 | Wu |
| 2016/0339409 | A1 | 11/2016 | Banyai et al. |
| 2016/0340672 | A1 | 11/2016 | Banyai et al. |
| 2016/0354752 | A1 | 12/2016 | Banyai et al. |
| 2017/0037124 | A1 | 2/2017 | Gusarova et al. |
| 2017/0066844 | A1 | 3/2017 | Glanville |
| 2017/0081716 | A1 | 3/2017 | Peck |
| 2017/0095785 | A1 | 4/2017 | Banyai et al. |
| 2017/0159044 | A1 | 6/2017 | Toro et al. |
| 2017/0253644 | A1 | 9/2017 | Steyaert et al. |
| 2017/0327819 | A1 | 11/2017 | Banyai et al. |
| 2017/0357752 | A1 | 12/2017 | Diggans |
| 2017/0362589 | A1 | 12/2017 | Banyai et al. |
| 2018/0029001 | A1 | 2/2018 | Banyai et al. |
| 2018/0104664 | A1 | 4/2018 | Fernandez |
| 2018/0142289 | A1 | 5/2018 | Zeitoun et al. |
| 2018/0253563 | A1 | 9/2018 | Peck et al. |
| 2018/0264428 | A1 | 9/2018 | Banyai et al. |
| 2018/0282721 | A1 | 10/2018 | Cox et al. |
| 2018/0326388 | A1 | 11/2018 | Banyai et al. |
| 2019/0062441 | A1 | 2/2019 | Yan et al. |
| 2019/0083596 | A1 | 3/2019 | Orentas et al. |
| 2019/0135926 | A1 | 5/2019 | Glanville |
| 2019/0314783 | A1 | 10/2019 | Banyai et al. |
| 2019/0352635 | A1 | 11/2019 | Toro et al. |
| 2019/0366293 | A1 | 12/2019 | Banyai et al. |
| 2019/0366294 | A1 | 12/2019 | Banyai et al. |
| 2020/0017907 | A1 | 1/2020 | Zeitoun et al. |
| 2020/0102611 | A1 | 4/2020 | Zeitoun et al. |
| 2020/0156037 | A1 | 5/2020 | Banyai et al. |
| 2020/0181667 | A1 | 6/2020 | Wu et al. |
| 2020/0222875 | A1 | 7/2020 | Peck et al. |
| 2020/0283760 | A1 | 9/2020 | Nugent et al. |
| 2020/0299322 | A1 | 9/2020 | Indermuhle et al. |
| 2020/0299684 | A1 | 9/2020 | Toro et al. |
| 2020/0308575 | A1 | 10/2020 | Sato |
| 2020/0325235 | A1 | 10/2020 | Tabibiazar et al. |
| 2020/0330953 | A1 | 10/2020 | Banyai et al. |
| 2020/0342143 | A1 | 10/2020 | Peck |
| 2021/0002710 | A1 | 1/2021 | Gantt et al. |
| 2021/0040476 | A1 | 2/2021 | Cox et al. |
| 2021/0071168 | A1 | 3/2021 | Nugent et al. |
| 2021/0102192 | A1 | 4/2021 | Tabibiazar et al. |
| 2021/0102195 | A1 | 4/2021 | Sato et al. |
| 2021/0102198 | A1 | 4/2021 | Cox et al. |
| 2021/0115594 | A1 | 4/2021 | Cox et al. |
| 2021/0129108 | A1 | 5/2021 | Marsh et al. |
| 2021/0142182 | A1 | 5/2021 | Bramlett et al. |
| 2021/0170356 | A1 | 6/2021 | Peck et al. |
| 2021/0179724 | A1 | 6/2021 | Sato et al. |
| 2021/0180046 | A1 | 6/2021 | Cox et al. |
| 2021/0207197 | A1 | 7/2021 | Gantt et al. |
| 2021/0332078 | A1 | 10/2021 | Wu |
| 2021/0348220 | A1 | 11/2021 | Zeitoun et al. |
| 2021/0355194 | A1 | 11/2021 | Sato et al. |
| 2021/0395344 | A1 | 12/2021 | Sato et al. |
| 2022/0032256 | A1 | 2/2022 | Lackey et al. |
| 2022/0064206 | A1 | 3/2022 | Fernandez et al. |
| 2022/0064313 | A1 | 3/2022 | Sato et al. |
| 2022/0064628 | A1 | 3/2022 | Toro et al. |
| 2022/0106586 | A1 | 4/2022 | Nugent et al. |
| 2022/0106590 | A1 | 4/2022 | Arbiza et al. |
| 2022/0135690 | A1 | 5/2022 | Sato et al. |
| 2022/0135965 | A1 | 5/2022 | Gantt et al. |
| 2022/0145289 | A1 | 5/2022 | Lackey et al. |
| 2022/0206001 | A1 | 6/2022 | Sato |
| 2022/0243195 | A1 | 8/2022 | Nugent et al. |
| 2022/0246236 | A1 | 8/2022 | Amirav-Drory |
| 2022/0259319 | A1 | 8/2022 | Sato et al. |
| 2022/0259638 | A1 | 8/2022 | Brown |
| 2022/0277808 | A1 | 9/2022 | Arbiza et al. |
| 2022/0281989 | A1 | 9/2022 | Glanville |
| 2022/0307010 | A1 | 9/2022 | Sato et al. |
| 2022/0315971 | A1 | 10/2022 | Wu et al. |
| 2022/0323924 | A1 | 10/2022 | Lackey et al. |
| 2022/0325276 | A2 | 10/2022 | Banyai et al. |
| 2022/0325278 | A1 | 10/2022 | Nugent et al. |
| 2022/0348659 | A1 | 11/2022 | Sato et al. |
| 2022/0356463 | A1 | 11/2022 | Shen et al. |
| 2022/0356468 | A1 | 11/2022 | Sato et al. |
| 2022/0411784 | A1 | 12/2022 | Sato et al. |
| 2023/0002478 | A1 | 1/2023 | Sato et al. |
| 2023/0054232 | A1 | 2/2023 | Peck |
| 2023/0086062 | A1 | 3/2023 | Banyai et al. |
| 2023/0096464 | A1 | 3/2023 | Sato |
| 2023/0115861 | A1 | 4/2023 | Nugent et al. |
| 2023/0153452 | A1 | 5/2023 | Peck et al. |
| 2023/0158469 | A1 | 5/2023 | Lackey et al. |
| 2023/0175062 | A1 | 6/2023 | Lackey et al. |
| 2023/0185971 | A1 | 6/2023 | Peck |
| 2023/0192818 | A1 | 6/2023 | Sato et al. |
| 2023/0192819 | A1 | 6/2023 | Sato et al. |
| 2023/0193383 | A1 | 6/2023 | Peck |
| 2023/0193513 | A1 | 6/2023 | Tabibiazar et al. |
| 2023/0211308 | A1 | 7/2023 | Banyai et al. |

FOREIGN PATENT DOCUMENTS

| | | | |
|---|---|---|---|
| JP | H07505530 | A | 6/1995 |
| JP | 2001518086 | A | 10/2001 |
| JP | 2002538790 | A | 11/2002 |

(56) References Cited

FOREIGN PATENT DOCUMENTS

| | | | |
|---|---|---|---|
| JP | 2004268394 | A | 9/2004 |
| JP | 2006503586 | A | 2/2006 |
| JP | 2007314746 | A | 12/2007 |
| JP | 2008214343 | A | 9/2008 |
| JP | 2009294195 | A | 12/2009 |
| JP | 2012507513 | A | 3/2012 |
| JP | 2016527313 | A | 9/2016 |
| JP | 2020536504 | A | 12/2020 |
| WO | WO-9320242 | A1 | 10/1993 |
| WO | 2000043507 | A1 | 7/2000 |
| WO | WO-02072791 | A2 | 9/2002 |
| WO | WO-2004039953 | A2 | 5/2004 |
| WO | WO-2005018536 | A2 | 3/2005 |
| WO | WO-2005059096 | A2 | 6/2005 |
| WO | 2008003116 | A2 | 1/2008 |
| WO | WO-2008054543 | A2 | 5/2008 |
| WO | WO-2008063135 | A1 | 5/2008 |
| WO | WO-2010053443 | A1 | 5/2010 |
| WO | 2010063818 | A2 | 6/2010 |
| WO | 2011056644 | A2 | 5/2011 |
| WO | WO-2011109031 | A1 | 9/2011 |
| WO | WO-2012078312 | A2 | 6/2012 |
| WO | WO-2012154201 | A1 | 11/2012 |
| WO | 2013134881 | A1 | 9/2013 |
| WO | WO-2014021938 | A1 | 2/2014 |
| WO | 2015021080 | A2 | 2/2015 |
| WO | 2015063331 | A1 | 5/2015 |
| WO | 2016161244 | A2 | 10/2016 |
| WO | 2016173719 | A1 | 11/2016 |
| WO | WO-2022010934 | A2 | 1/2022 |
| WO | WO-2022046944 | A2 | 3/2022 |
| WO | WO-2022076326 | A1 | 4/2022 |
| WO | WO-2022086866 | A1 | 4/2022 |
| WO | WO-2022087293 | A1 | 4/2022 |
| WO | WO-2022098662 | A2 | 5/2022 |
| WO | WO-2022159620 | A1 | 7/2022 |
| WO | WO-2022178137 | A1 | 8/2022 |
| WO | WO-2022204309 | A1 | 9/2022 |
| WO | WO-2022204316 | A2 | 9/2022 |
| WO | WO-2022217004 | A1 | 10/2022 |
| WO | WO-2022235579 | A1 | 11/2022 |
| WO | WO-2022235584 | A1 | 11/2022 |
| WO | WO-2022271884 | A2 | 12/2022 |
| WO | WO-2023023183 | A2 | 2/2023 |
| WO | WO-2023023190 | A2 | 2/2023 |
| WO | WO-2023023285 | A2 | 2/2023 |
| WO | WO-2023069367 | A1 | 4/2023 |
| WO | WO-2023076419 | A2 | 5/2023 |
| WO | WO-2023076420 | A2 | 5/2023 |
| WO | WO-2023076687 | A1 | 5/2023 |
| WO | WO-2023091609 | A2 | 5/2023 |
| WO | WO-2023091614 | A2 | 5/2023 |
| WO | WO-2023102034 | A2 | 6/2023 |
| WO | WO-2023114432 | A2 | 6/2023 |

OTHER PUBLICATIONS

Burgess et al. Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue. J. Cell Biol. 111:2129-2138, 1990 (Year: 1990).*

Brown et al., J Immunol. May 1996;156(9):3285-91 (Year: 1996).*

Greenspan et al. 1999 Defining epitopes: It's not as easy as it seems; Nature Biotechnology, 17:936-937 (Year: 1999).*

Bork. Powers and Pitfalls in Sequence Analysis: The 70% Hurdle. Genome Research, 2000, 10:398-400 (Year: 2000).*

Skolnick et al., Trends Biotechnol. Jan. 2000;18(1):34-9 (Year: 2000).*

Vajdos et al., J Mol Biol. Jul. 5, 2002;320(2):415-28 at 416 (Year: 2002).*

Miosge, Proc Natl Acad Sci U S A. Sep. 15, 2015;112(37):E5189-98 (Year: 2015).*

Kulmanov et al., Bioinformatics, 34(4), 2018, 660-668 (Year: 2018).*

Agbavwe et al.: Efficiency, Error and Yield in Light-Directed Maskless Synthesis of DNA Microarrays. Journal of Nanobiotechnology. 9(57):1-17 (2011).

Hasin-Brumshtein et al.: The Effects of Mismatches on DNA Capture by Hybridization. Twist WhitePaper. 6 pages (May 7, 2019).

PCT/US2021/047616 International Preliminary Report on Patentability dated Mar. 9, 2023.

PCT/US2021/047616 International Search Report and Written Opinion dated Feb. 15, 2022.

PCT/US2021/047616 Invitation to Pay Additional Fees dated Dec. 1, 2021.

U.S. Appl. No. 16/039,256 Office Action dated May 10, 2022.

U.S. Appl. No. 16/737,401 Final Office Action dated Jun. 13, 2022.

U.S. Appl. No. 16/737,401 Office Action dated Jan. 5, 2022.

U.S. Appl. No. 16/737,401 Restriction Requirement dated Nov. 15, 2021.

Al-Lazikani et al. Standard conformations for the canonical structures of immunoglobulins. J Mol Biol. 273(4):927-48 (1997).

Altschul et al.: Gapped BLAST and PSI-BLAST: a new generation of protein database search programs. Nucleic acids research vol. 25,17 (1997): 3389-402. doi:10.1093/nar/25.17.3389.

Arkles et al.: The Role of Polarity in the Structure of Silanes Employed in Surface Modification. Silanes and Other Coupling Agents. 5:51-64 (2009).

ATDBio. Nucleic Acid Structure, Nucleic Acids Book, 9 pages, published on Jan. 22, 2005. from: http://www.atdbio.com/content/5/Nucleic-acid-structure.

ATDBio. Solid-Phase Oligonucleotide Synthesis, Nucleic Acids Book, 20 pages, Published on Jul. 31, 2011. from: http://www.atdbio.com/content/17/Solid-phase-oligonucleotide-synthesis.

Berg: Biochemistry. 5th ED. New York (2002) 148-149.

Blanchard et al.: High-Density Oligonucleotide Arrays. Biosensors & Bioelectronics, 11(6/7):687-690 (1996).

Buermans et al.: Next Generation sequencing technology: Advances and applications, Biochimica et Biophysica Acta (BBA)—Molecular Basis of Disease, 1842:1932-1941 (2014).

Cheng et al.: High throughput parallel synthesis of oligonucleotides with 1536 channel synthesizer. Nucleic Acids Res. 30(18):e93 (2002).

Cleary et al.: Production of complex nucleic acid libraries using highly parallel in situ oligonucleotide synthesis. Nat Methods. 1(3):241-248 (2004).

Cohen et al.: Human population: The next half century. Science. 302:1172-1175 (2003).

Cruse et al.: Atlas of Immunology. Third Edition. Boca Raton:CRC Press (pp. 282-283) (2010).

Elsik et al.: The Genome sequence of taurine cattle: A window of ruminant biology and evolution. Science. 324:522-528 (2009).

Fodor et al.: Light-directed, spatially addressable parallel chemical synthesis. Science. 251(4995):767-773 (1991).

Gao et al.: A method for the generation of combinatorial antibody libraries using pIX phage display. PNAS 99(20):12612-12616 (2002).

GE Healthcare. AKTA oligopilot plus. Data File 18-114-66 ADC. 8 pages (2006).

GE Healthcare. Robust and cost-efficient oligonucleotide synthesis. Application Note 28-4058-08 AA. 4 pages (2005).

Gibson et al.: Creation of a Bacterial Cell Controlled by a Chemically Synthesized Genome. Science. 329(5989):52-56 (2010).

Honegger et al. Yet another numbering scheme for immunoglobulin variable domains: an automatic modeling and analysis tool. J Mol Biol 309(3):657-70 (2001).

Hudson: Matrix Assisted Synthetic Transformations: A Mosaic of Diverse Contributions. Journal of Combinatorial Chemistry. 1(6):403-457 (1999).

Kabat et al. Sequences of proteins of immunological interest. NIH Publ. No. 91-3242 1:647-669 (1991).

Karlin et al.: Methods for assessing the statistical significance of molecular sequence features by using general scoring schemes. Proc. Natl. Acad. Sci. 87: 2264-2268 (1990).

(56) References Cited

OTHER PUBLICATIONS

Karlin et al.: Applications and statistics for multiple high-scoring segments in molecular sequences. PNAS USA 90(12):5873-5787 (1993).
Kong et al.: Parallel gene synthesis in a microfluidic device. Nucleic Acids Res. 35(8):e61 (2007).
Kosuri and Church. Large-scale de novo DNA synthesis: technologies and applications. Nature Methods. 11:499-507 (2014) Available at: http://www.nature.com/nmeth/journal/v11/n5/full/nmeth.2918.html.
Kosuri et al.: A scalable gene synthesis platform using high-fidelity DNA microchips Nat.Biotechnol. 28(12):1295-1299 (2010).
Krayden, Inc.: A Guide to Silane Solutions. Silane coupling agents. 7 pages. Published on May 31, 2005 at: http://krayden.com/pdf/xia_silane_chemistry.pdf.
Lausted et al.: POSaM: a fast, flexible, open-source, inkjet oligonucleotide synthesizer and microarrayer. Genome Biology. 5:R58, 17 pages (2004) available at https://www.ncbi.nlm.nih.gov/pmc/articles/PMC507883/.
Lebl et al.: Economical Parallel Oligonucleotide and Peptide Synthesizer—Pet Oligator. Int. J. Peptide Res. Ther. 13(1-2):367-376 (2007).
Lefranc et al. IMGT unique numbering for immunoglobulin and T cell receptor variable domains and Ig superfamily V-like domains. Dev Comp Immunol 27(1):55-77 (2003).
Leproust et al.: Synthesis of high-quality libraries of long (150mer) oligonucleotides by a novel depurination controlled process. Nucleic Acids Research. 38(8):2522-2540 (2010).
Lewontin and Harti, Population genetics in forensic DNA typing. Science, 254:1745-1750, 1991.
Ma et al.: DNA synthesis, assembly and application in synthetic biology. Current Opinion in Chemical Biology. 16:260-267 (2012).
Ma et al.: Versatile surface functionalization of cyclic olefin copolymer (COC) with sputtered SiO2 thin film for potential BioMEMS applications. Journal of Materials Chemistry. 11 pages (2009).
MacCallum et al. Antibody-antigen interactions: contact analysis and binding site topography. J Mol Biol. 262(5):732-745 (1996).
Mazor et al.: Isolation of Full-Length IgG Antibodies from Combinatorial Libraries Expressed in *Escherichia coli*; Antony S. Dimitrov (ed.), Therapeutic Antibodies: Methods and Protocols, vol. 525, Chapter 11, pp. 217-239 (2009).
McBride & Caruthers. An investigation of several deoxynucleoside phosphoramidites useful for synthesizing deoxyoligonucleotides. Tetrahedron Lett. 24:245-248 (1983).
Mitra et al.: In situ localized amplification and contact replication of many individual DNA molecules. Nucleic Acids Res. 27(24):e34 (1999).
Morin et al.: Profiling the HeLa S3 transcriptome using randomly primed cDNA and massively parallel short-read sequencing. Biotechniques. 45:81-94 (2008).
Opposition to European Patent No. 3030682 filed Mar. 3, 2021.
PCT/US2014/049834 International Preliminary Report on Patentability dated Feb. 18, 2016.
PCT/US2014/049834 International Search Report and Written Opinion mailed Mar. 19, 2015.
PCT/US2014/049834 Invitation to Pay Additional Fees and, where applicable, protest fee mailed Jan. 5, 2015.
Pirrung. How to make a DNA chip. Angew. Chem. Int. Ed. 41:1276-1289 (2002).
Pray. Discovery of DNA Structure and Function: Watson and Crick. Nature Education.6 pages (2008) available at: http://www.nature.com/scitable/topicpage/discovery-of-dna-structure-and-function-watson-397.
Quan et al.: Parallel on-chip gene synthesis and application to optimization of protein expression. Nature Biotechnology. 29:449-452 (2011).
Rafalski and Morgante, Corn and humans: recombination and linkage disequilibrium in two genomes of similar size. Trends in Genetics. 20(2):103-111. (2004).
Rogozin et al.: Origin and evolution of spliceosomal introns. Biology Direct, 7:11 (2012).
Saaem et al.: In situ synthesis of DNA microarray on functionalized cyclic olefin copolymer substrate ACS Applied Materials & Interfaces. 2(2):491-497 (2010).
Sargolzaei et al.: Extent of linkage disequilibrium in Holstein cattle in North America. J.Dairy Science. 91:2106-2117 (2007).
Srivannavit et al.: Design and fabrication of microwell array chips for a solution-based, photogenerated acid-catalyzed parallel oligonucleotide DNA synthesis. Sensors and Actuators A. 116:150-160 (2004).
Steel. The Flow-Thru Chip a Three-dimensional biochip platform. In: Schena, Microarray Biochip Technology, Chapter 5, Natick, MA: Eaton Publishing, 2000, 33 pages.
Taylor et al.: Impact of surface chemistry and blocking strategies on DNA microarrays. Nucleic Acids Research, 31(16):e87 19 pages (2003).
Tian et al.: Accurate multiplex gene synthesis from programmable DNA microchips. Nature. 432(7020):1050-1054 (2004).
Van Tassell et al.: SNP discovery and allele frequency estimation by deep sequencing of reduced representation libraries. Nature Methods. 5:247-252 (2008).
Whitelegg et al. WAM: an improved algorithm for modelling antibodies on the WEB. Protein Eng. 13:819-24 (2000).
Wootton et al. Statistics of local complexity in amino acid sequences and sequence databases. Computers & Chemistry 17(2):149-163 (Jun. 1993).
Xu et al.: Design of 240,000 orthogonal 25mer DNA barcode probes. PNAS. 106(7):2289-2294 (2009).
Zhang et al., "Rational Design of a 1-15 Humanized Glucagon-Like Peptide-1 Receptor Agonist Antibody", Angewandte Chemie International Edition, Verlag Chemie, vol. 54, No. 7, Dec. 29, 2014 (Dec. 29, 2014), pp. 2126-2130.
Chan et al., "Virtual screening of human Class-A GPCRs using ligand profiles built on multiple ligand-receptor interactions," J Mol Biol. Aug. 7, 2020; 432(17): 4872-4890. doi:10.1016/j.jmb.2020.07.003.
Douthwaite, J., et al., "Affinity maturation of a novel antagonistic human monoclonal antibody with a long VH CDR3 targeting the Class A GPCR formyl-peptide receptor 1," mAbs, vol. 7, No. 1, pp. 152-166 (2015).
Extended European Search Report issued in European Application No. 18853509.0, dated May 11, 2021, (9 pages).
Fernández-Quintero et al.: Characterizing the Diversity of the CDR-H3 Loop Conformational Ensembles in Relationship to Antibody Binding Properties. Front. Immunol. 9:1-11 (2019).
Frederickson, S., et al., "A rationally designed agonist antibody fragment that functionally mimics thrombopoietin," PNAS, vol. 103, No. 39, pp. 14307-14312 (2006).
Hennen, S., et al., "Structural insight into antibody-mediated antagonism of the Glucagon-like peptide-1 Receptor," Scientific Reports, 6:26236 (2016).
International Preliminary Report on Patentability issued in International Application No. PCT/US2018/050511, dated Mar. 26, 2020, by X. Wang (11 pages).
International Search Report & Written Opinion of International Application No. PCT/US2018/050511 dated Jan. 11, 2019, by B. R. Copenheaver (13 pages).
International Search Report and Written Opinion of International Application No. PCT/US20/19986, dated Jul. 29, 2024, (18 pages).
Jo, M., et al., "Engineering therapeutic antibodies targeting G-protein-coupled receptors," Experimental & Molecular Medicine, vol. 48, No. e207, pp. 1-9 (2016).
Liu et al., "Functional GLP-1R antibodies identified from a synthetic GPCR-focused library demonstrate potent blood glucose control," MABS, vol. 13, No. 1, Jan. 1, 2021.
Munk et al., "An Online Resource for GPCR Structure Determination and Analysis," Nat Methods. Feb. 1, 2019; 16(2): 151-162. doi:10.1038/s41592-018-0302-x.
Peterson et al., "Optimization of a Glucagon-Like Peptide 1 Receptor Antagonist Antibody for Treatment of Hyperinsulinism", Diabetes, vol. 72, No. 9, Jun. 26, 2023, pp. 1320-1329.

(56) References Cited

OTHER PUBLICATIONS

Pigott, C., et al., "Peptide Grafting Approach The Use of a Novel Discovery Platform to Identify Peptide-Grafted Antibodies that Activate GLP-1 Receptor Signaling," URL:http://www.innovativetargeting.com/wp-content/uploads/2013/12/Pigott-et-al-Antibody-Engineering-2013.pdf (2013).
Regep et al.: The H3 loop of antibodies shows unique structural characteristics. Proteins. 85(7):1311-1318 (2017).
Supplemental European Search Report issued in European Application No. EP 21 86 2681, dated Aug. 22, 2024, (13 pages).
Supplementary Partial European Search Report issued in European Application No. EP 20762890, dated Nov. 3, 2022, (17 pages).
Xu, Y., et al., "Coordination between the Polymerase and 5'-Nuclease Components of DNA Polymerase I of *Escherichia coli*," Journal of Biological Chemistry, vol. 275, No. 27, pp. 20949-20955 (2000).

* cited by examiner

| | | HCDR3 |
|---|---|---|
| **Glucagon-like peptide 1** | | **HAEGTFTSDVSSYLEGQAAKEFIAWLVKGRG** |
| GLP1R-3 | (SEQ ID NO: 20) | CAKHMSMQEGAVTG**EGQAAKEFIAWLVKGR**VRADLVGDAFDVW |
| GLP1R-8 | (SEQ ID NO: 21) | CARDGRGSLPRPKGGPQTVG**EGQAAKEFIAWLVKG**GLTYDSSEDSGGAFDIW |
| GLP1R-56 | (SEQ ID NO: 27) | CARANQHFFSGAEG**EGQAAKEFIAWLVKG**IIPGYHYYGMDVW |
| GLP1R-58 | (SEQ ID NO: 28) | CARANQHFGLHAQG**EGQAAKEFIAWLVKG**SGTYGYHYYGMDVW |
| GLP1R-60 | (SEQ ID NO: 29) | CAKHMSMQDYLVIG**EGQAAKEFIAWLVKG**GPARADLVGDAFDVW |
| GLP1R-72 | (SEQ ID NO: 32) | CARDMYYDF**H**P**EGTFTSDVSSYLEGQAAKEFIAWLVKG**SLIYEVVPADDAFDIW |
| **Glucagon-like peptide 2** | | **HADGSFSDEMNTILDNLAARDFINWLIQTKITD** |
| GLP1R-25 | (SEQ ID NO: 23) | CARANQHFLSHAG**AARDFINWLIQTKIT**GLGSGYHYYGMDVW |
| GLP1R-30 | (SEQ ID NO: 25) | CARDMYYDFLKIG**DNLAARDFINWLIQTKITD**GTDTEVVPADDAFDIW |
| GLP1R-70 | (SEQ ID NO: 30) | CARDGRGSLPRPKGGPPSSG**RDFINWLIQTKITD**GFRYDSSEDSGGAFDIW |
| GLP1R-98 | (SEQ ID NO: 36) | CARDMYYDFGYFTG**MNTILDNLAARDFINWLIQTKITD**RGGGSGGSGGSGGSGGSGEVVPADDAFDIW |
| GLP1R-2 | (SEQ ID NO: 19) | CARDMYYDFETVVEGIQWYEALKAGKLGEVVPADDAFDIW |
| GLP1R-10 | (SEQ ID NO: 22) | CARANQHFFVPGSLKVWLKGVAPESSSEYDSSEDSGGAFDIW |
| GLP1R-26 | (SEQ ID NO: 24) | CAKHMSMQEGVLQGQIPSTIDWEGLLHLIRADLVGDAFDVW |

*FIG. 15*

| | GLP-1 (7-36) | + GLP-1 (7-36) |
|---|---|---|
| $Ec_{50}$ | 3.94 | ND |

| | + no Ab | + GLP1R-3 |
|---|---|---|
| $Ec_{50}$ | 0.0235 | 0.11 |

| | + no Ab | + GLP1R-3 |
|---|---|---|
| $Ec_{50}$ | 5.6 | 23.4 |

| | CHO-GLP1R | CHO-Parent |
|---|---|---|
| $Ec_{50}$ | 15.5 | ND |

| | GLP1R59-2 | GLP-1 (7-36) |
|---|---|---|
| $Ec_{50}$ | 0.042 | 0.085 |

| | GLP1R59-2 | GLP-1 (7-36) |
|---|---|---|
| $Ec_{50}$ | 6.7 | 34.6 |

a: Ctrl vs GLP1R-3 <0.0001
b: Ctrl vs Exendin 1 mg/kg p<0.0001
*: GLP1R-3 vs Exendin 0.23 mg/kg p<0.03
c: Exendin 1 mg/kg vs Exendin 0.23 mg/kg p= 0.03

| Round 1 | Round 2 | Round 3 | Round 4 | Round 5 |
|---|---|---|---|---|
| $3.0x10^{12}$<br>$4.0x10^{6}$ | $3.2x10^{13}$<br>$1.9x10^{7}$ | $1.0x10^{13}$<br>$3.1x10^{7}$ | $3.6x10^{12}$<br>$1.5x10^{7}$ | $1.8x10^{13}$<br>$7.2x10^{7}$ |

| Round 1 | Round 2 | Round 3 | Round 4 | Round 5 |
|---|---|---|---|---|
| $3.0x10^{12}$ | $1.6x10^{13}$ | $2.0x10^{13}$ | $5.4x10^{12}$ | $1.8x10^{13}$ |
| $2.0x10^{6}$ | $1.8x10^{7}$ | $1.5x10^{7}$ | $1.7x10^{7}$ | $4.6x10^{7}$ |

| IC50 (nM) to agonist | |
|---|---|
| 211-009 | 0.06177 |
| 221-017 | 0.163 |
| 221-033 | 0.2601 |
| 221-065 | 0.162 |
| 221-084 | 0.01574 |
| 222-012 | 0.0285 |
| 222-016 | 0.3353 |
| 222-023 | 0.267 |
| 222-052 | 0.01773 |
| 222-073 | 0.02394 |
| 01-3 | 0.04982 |

METHODS AND COMPOSITIONS RELATING TO GLP1R VARIANTS

CROSS-REFERENCE

This application claims the benefit of U.S. Provisional Patent Application No. 63/070,734 filed on Aug. 26, 2020, and U.S. Provisional Patent Application No. 63/081,801 filed on Sep. 22, 2020, each of which is incorporated by reference in its entirety.

SEQUENCE LISTING

The instant application contains a Sequence Listing which has been submitted electronically in ASCII format and is hereby incorporated by reference in its entirety. Said ASCII copy, created on Sep. 22, 2021, is named 44854-808_201_SL.txt and is 838,237 bytes in size.

BACKGROUND

G protein-coupled receptors (GPCRs) are implicated in a wide variety of diseases. Raising antibodies to GPCRs has been difficult due to problems in obtaining suitable antigens because GPCRs are often expressed at low levels in cells and are very unstable when purified. Thus, there is a need for improved agents for therapeutic intervention which target GPCRs.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF SUMMARY

Provided herein are antibodies or antibody fragments that binds GLP1R, comprising an immunoglobulin heavy chain and an immunoglobulin light chain: (a) wherein the immunoglobulin heavy chain comprises an amino acid sequence at least about 90% identical to that set forth in Table 9; and (b) wherein the immunoglobulin light chain comprises an amino acid sequence at least about 90% identical to that set forth in Table 10. Further provided herein are antibodies or antibody fragments, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are antibodies or antibody fragments, wherein the antibody or antibody fragment thereof is chimeric or humanized. Further provided herein are antibodies or antibody fragments, wherein the antibody or antibody fragment has an EC50 less than about 25 nanomolar in a cAMP assay. Further provided herein are antibodies or antibody fragments, wherein the antibody or antibody fragment has an EC50 less than about 20 nanomolar in a cAMP assay. Further provided herein are antibodies or antibody fragments, wherein the antibody or antibody fragment has an EC50 less than about 10 nanomolar in a cAMP assay. Further provided herein are antibodies or antibody fragments, wherein the antibody or antibody fragment is an agonist of GLP1R. Further provided herein are antibodies or antibody fragments, wherein the antibody or antibody fragment is an antagonist of GLP1R. Further provided herein are antibodies or antibody fragments, wherein the antibody or antibody fragment is an allosteric modulator of GLP1R. Further provided herein are antibodies or antibody fragments, wherein the allosteric modulator of GLP1R is a negative allosteric modulator.

Provided herein are methods of treating a metabolic disease or disorder comprising administering an antibody or antibody fragment that binds GLP1R, wherein the antibody or antibody fragment comprises a sequence set forth in Tables 7-13. Further provided herein are methods, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are methods, wherein the antibody or antibody fragment thereof is chimeric or humanized. Further provided herein are methods, wherein the antibody or antibody fragment has an EC50 less than about 25 nanomolar in a cAMP assay. Further provided herein are methods, wherein the antibody or antibody fragment has an EC50 less than about 20 nanomolar in a CAMP assay. Further provided herein are methods, wherein the antibody or antibody fragment has an EC50 less than about 10 nanomolar in a cAMP assay. Further provided herein are methods, wherein the antibody or antibody fragment is an agonist of GLP1R. Further provided herein are methods, wherein the antibody or antibody fragment is an antagonist of GLP1R. Further provided herein are methods, wherein the antibody or antibody fragment is an allosteric modulator of GLP1R. Further provided herein are methods, wherein the allosteric modulator of GLP1R is a negative allosteric modulator. Further provided herein are methods, wherein the antibody or antibody fragment is an allosteric modulator. Further provided herein are methods, wherein the antibody or antibody fragment is a negative allosteric modulator. Further provided herein are methods, wherein the metabolic disease or disorder is Type II diabetes or obesity.

Provided herein are antibodies or antibody fragments comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 441-619; (b) an amino acid sequence of CDRH2 is as set forth in any one of SEQ ID NOs: 620-798; (c) an amino acid sequence of CDRH3 is as set forth in any one of SEQ ID NOs: 799-977; (d) an amino acid sequence of CDRL1 is as set forth in any one of SEQ ID NOs: 978-1156; (e) an amino acid sequence of CDRL2 is as set forth in any one of SEQ ID NOs: 1157-1335; and (f) an amino acid sequence of CDRL3 is as set forth in any one of SEQ ID NOs: 1336-1347 and 1353-1519. Further provided herein are antibodies or antibody fragments, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are antibodies or antibody fragments, wherein the antibody or antibody fragment thereof is chimeric or humanized. Further provided herein are antibodies or antibody fragments, wherein the antibody or antibody fragment has an EC50 less than about 25 nanomolar in a cAMP assay. Further provided herein are antibodies or antibody fragments, wherein the antibody or antibody fragment has an EC50 less than about 20 nanomolar in a cAMP assay. Further provided herein are antibodies or antibody fragments, wherein the antibody or antibody fragment has an EC50 less than about 10 nanomolar in a CAMP assay. Further provided herein are antibodies or antibody fragments, wherein the antibody or antibody fragment is an agonist of GLP1R. Further provided herein are antibodies or antibody fragments, wherein the antibody or antibody fragment is an antagonist of GLP1R. Further provided herein are antibodies or antibody fragments, wherein the antibody or antibody fragment is an allosteric modulator of GLP1R. Further provided herein are antibodies or antibody fragments, wherein the allosteric modulator of GLP1R is a negative allosteric modulator. Further provided herein are antibodies or antibody fragments, wherein the VH comprises a sequence at least about 90% identical to any one of SEQ ID NOs: 58-77. Further provided herein are antibodies or antibody fragments, wherein the VH comprises a sequence of any one of SEQ ID NOs: 58-77. Further provided herein are antibodies or antibody fragments, wherein the VL comprises a sequence at least about 90% identical to any one of SEQ ID NOs: 92-111. Further provided herein are antibodies or antibody fragments, wherein the VL comprises a sequence of any one of SEQ ID NOs: 92-111.

Provided herein are methods of treating a metabolic disease or disorder comprising administering an antibody or antibody fragment that binds GLP1R comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 441-619; (b) an amino acid sequence of CDRH2 is as set forth in any one of SEQ ID NOs: 620-798; (c) an amino acid sequence of CDRH3 is as set forth in any one of SEQ ID NOs: 799-977; (d) an amino acid sequence of CDRL1 is as set forth in any one of SEQ ID NOs: 978-1156; (e) an amino acid sequence of CDRL2 is as set forth in any one of SEQ ID NOs: 1157-1335; and (f) an amino acid sequence of CDRL3 is as set forth in any one of SEQ ID NOs: 1336-1347 and 1353-1519. Further provided herein are methods, wherein the antibody is a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv), a single chain antibody, a Fab fragment, a F(ab')2 fragment, a Fd fragment, a Fv fragment, a single-domain antibody, an isolated complementarity determining region (CDR), a diabody, a fragment comprised of only a single monomeric variable domain, disulfide-linked Fvs (sdFv), an intrabody, an anti-idiotypic (anti-Id) antibody, or ab antigen-binding fragments thereof. Further provided herein are methods, wherein the antibody or antibody fragment thereof is chimeric or humanized. Further provided herein are methods, wherein the antibody or antibody fragment has an EC50 less than about 25 nanomolar in a cAMP assay. Further provided herein are methods, wherein the antibody or antibody fragment has an EC50 less than about 20 nanomolar in a cAMP assay. Further provided herein are methods, wherein the antibody or antibody fragment has an EC50 less than about 10 nanomolar in a cAMP assay. Further provided herein are methods, wherein the antibody or antibody fragment is an agonist of GLP1R. Further provided herein are methods, wherein the antibody or antibody fragment is an antagonist of GLP1R. Further provided herein are methods, wherein the antibody or antibody fragment is an allosteric modulator of GLP1R. Further provided herein are methods, wherein the allosteric modulator of GLP1R is a negative allosteric modulator. Further provided herein are methods, wherein the antibody or antibody fragment is an allosteric modulator. Further provided herein are methods, wherein the antibody or antibody fragment is a negative allosteric modulator. Further provided herein are methods, wherein the VH comprises a sequence at least about 90% identical to any one of SEQ ID NOs: 58-77. Further provided herein are methods, wherein the VH comprises a sequence of any one of SEQ ID NOs: 58-77. Further provided herein are methods, wherein the VL comprises a sequence at least about 90% identical to any one of SEQ ID NOs: 92-111. Further provided herein are methods, wherein the VL comprises a sequence of any one of SEQ ID NOs: 92-111. Further provided herein are methods, wherein the metabolic disease or disorder is Type II diabetes or obesity.

Provided herein are nucleic acid compositions comprising: a) a first nucleic acid encoding a variable domain, heavy chain region (VH) comprising complementarity determining regions CDRH1, CDRH2, and CDRH3, and wherein (i) an amino acid sequence of CDRH1 is as set forth in any one of SEQ ID NOs: 441-619; (ii) an amino acid sequence of CDRH2 is as set forth in any one of SEQ ID NOs: 620-798; (iii) an amino acid sequence of CDRH3 is as set forth in any one of SEQ ID NOs: 799-977; b) a second nucleic acid encoding a variable domain, light chain region (VL) comprising complementarity determining regions CDRL1, CDRL2, and CDRL3, and wherein (i) an amino acid sequence of CDRL1 is as set forth in any one of SEQ ID NOs: 978-1156; (ii) an amino acid sequence of CDRL2 is as set forth in any one of SEQ ID NOs: 1157-1335; and (iii) an amino acid sequence of CDRL3 is as set forth in any one of SEQ ID NOs: 1336-1347 and 1353-1519.

Provided herein are nucleic acid compositions comprising: a) a first nucleic acid encoding a variable domain, heavy chain region (VH) comprising an amino acid sequence at least about 90% identical to a sequence as set forth in any one of SEQ ID NOs: 58-77; b) a second nucleic acid encoding a variable domain, light chain region (VL) comprising at least about 90% identical to a sequence as set forth in any one of SEQ ID NOs: 92-111; and an excipient. Further provided herein are nucleic acid compositions, wherein the VH comprises an amino acid sequence as set forth in any one of SEQ ID NOs: 58-77. Further provided herein are nucleic acid compositions, wherein the VL comprises an amino acid sequence as set forth in any one of SEQ ID NOs: 92-111. Further provided herein are nucleic acid compositions, wherein the VH comprises an amino acid sequence as set forth in any one of SEQ ID NOs: 58-77, and wherein the VL comprises an amino acid sequence as set forth in any one of SEQ ID NOs: 92-111.

BRIEF DESCRIPTION OF THE DRAWINGS

FIG. 15 depicts HCDR3 loop sequences of the 13 unique GLP1R binders. Six of the clones have a GLP-1 motif, four of the clones have a GLP-2 motif, and three clones do not have a GLP-1 or GLP-2 motif. For the clones that have the GLP-1 or GLP-2 motif (bolded), residues that are similar to the GLP-1 sequence or the GLP-2 sequence are bolded and the residues that are different are left unbolded. Functional antagonists in the CAMP assay are enclosed by a box. FIG. 15 discloses SEQ ID NOS 1528, 1-2, 27, 12, 3, 32, 1529, 23, 25, 30, 1530, 19, 22 and 24, respectively, in order of appearance.

DETAILED DESCRIPTION

Figure 1A:
FIG. 1A depicts a first schematic of an immunoglobulin.
Figure 1B:
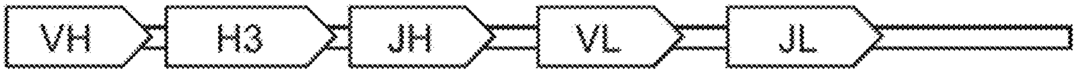
FIG. 1B depicts a second schematic of an immunoglobulin.
Figure 2:
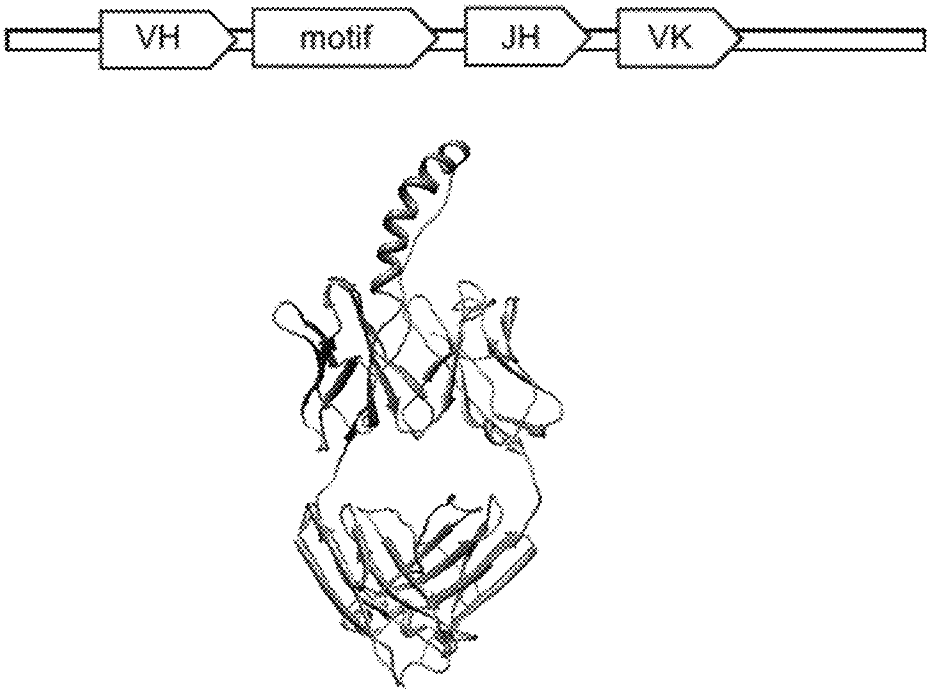
FIG. 2 depicts a schematic of a motif for placement in an immunoglobulin.

The present disclosure employs, unless otherwise indicated, conventional molecular biology techniques, which are within the skill of the art. Unless defined otherwise, all technical and scientific terms used herein have the same meaning as is commonly understood by one of ordinary skill in the art.

Definitions

Throughout this disclosure, various embodiments are presented in a range format. It should be understood that the description in range format is merely for convenience and brevity and should not be construed as an inflexible limitation on the scope of any embodiments. Accordingly, the description of a range should be considered to have specifically disclosed all the possible subranges as well as individual numerical values within that range to the tenth of the unit of the lower limit unless the context clearly dictates otherwise. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual values within that range, for example, 1.1, 2, 2.3, 5, and 5.9. This applies regardless of the breadth of the range. The upper and lower limits of these intervening ranges may independently be included in the smaller ranges, and are also encompassed within the disclosure, subject to any specifically excluded limit in the stated range. Where the stated range includes one or both of the limits, ranges excluding either or both of those included limits are also included in the disclosure, unless the context clearly dictates otherwise.

The terminology used herein is for the purpose of describing particular embodiments only and is not intended to be limiting of any embodiment. As used herein, the singular forms "a," "an" and "the" are intended to include the plural forms as well, unless the context clearly indicates otherwise. It will be further understood that the terms "comprises" and/or "comprising," when used in this specification, specify the presence of stated features, integers, steps, operations, elements, components, and/or groups, but do not preclude the presence or addition of one or more other features, integers, steps, operations, elements, components, and/or groups thereof. As used herein, the term "and/or" includes any and all combinations of one or more of the associated listed items.

Unless specifically stated or obvious from context, as used herein, the term "about" in reference to a number or range of numbers is understood to mean the stated number and numbers +/−10% thereof, or 10% below the lower listed limit and 10% above the higher listed limit for the values listed for a range.

Unless specifically stated, as used herein, the term "nucleic acid" encompasses double- or triple-stranded nucleic acids, as well as single-stranded molecules. In double- or triple-stranded nucleic acids, the nucleic acid strands need not be coextensive (i.e., a double-stranded nucleic acid need not be double-stranded along the entire length of both strands). Nucleic acid sequences, when provided, are listed in 5' to 3' direction, unless stated otherwise. Methods described herein provide for the generation of isolated nucleic acids. Methods described herein additionally provide for the generation of isolated and purified nucleic acids. A "nucleic acid" as referred to herein can comprise at least 5, 10, 20, 30, 40, 50, 60, 70, 80, 90, 100, 125, 150, 175, 200, 225, 250, 275, 300, 325, 350, 375, 400, 425, 450, 475, 500, 600, 700, 800, 900, 1000, 1100, 1200, 1300, 1400, 1500, 1600, 1700, 1800, 1900, 2000, or more bases in length. Moreover, provided herein are methods for the synthesis of any number of polypeptide-segments encoding nucleotide sequences, including sequences encoding non-ribosomal peptides (NRPs), sequences encoding non-ribosomal peptide-synthetase (NRPS) modules and synthetic variants, polypeptide segments of other modular proteins, such as antibodies, polypeptide segments from other protein families, including non-coding DNA or RNA, such as regulatory sequences e.g. promoters, transcription factors, enhancers, siRNA, shRNA, RNAi, miRNA, small nucleolar RNA derived from microRNA, or any functional or structural DNA or RNA unit of interest. The following are non-limiting examples of polynucleotides: coding or non-coding regions of a gene or gene fragment, intergenic DNA, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), small nucleolar RNA, ribozymes, complementary DNA (cDNA), which is a DNA representation of mRNA, usually obtained by reverse transcription of messenger RNA (mRNA) or by amplification; DNA molecules produced synthetically or by amplification, genomic DNA, recombinant polynucleotides, branched polynucleotides, plasmids, vectors, isolated DNA of any sequence, isolated RNA of any sequence, nucleic acid probes, and primers. cDNA encoding for a gene or gene fragment referred herein may comprise at least one region encoding for exon sequences without an intervening intron sequence in the genomic equivalent sequence.

GPCR Libraries for GLP1 Receptor

Provided herein are methods and compositions relating to G protein-coupled receptor (GPCR) binding libraries for glucagon-like peptide-1 receptor (GLP1R) comprising nucleic acids encoding for an immunoglobulin comprising a GPCR binding domain. Immunoglobulins as described herein can stably support a GPCR binding domain. The GPCR binding domain may be designed based on surface interactions of a GLP1R ligand and GLP1R. Libraries as described herein may be further variegated to provide for variant libraries comprising nucleic acids each encoding for a predetermined variant of at least one predetermined reference nucleic acid sequence. Further described herein are protein libraries that may be generated when the nucleic acid libraries are translated. In some instances, nucleic acid libraries as described herein are transferred into cells to generate a cell library. Also provided herein are downstream applications for the libraries synthesized using methods described herein. Downstream applications include identification of variant nucleic acids or protein sequences with enhanced biologically relevant functions, e.g., improved stability, affinity, binding, functional activity, and for the treatment or prevention of a disease state associated with GPCR signaling.

Provided herein are libraries comprising nucleic acids encoding for an immunoglobulin. In some instances, the immunoglobulin is an antibody. As used herein, the term antibody will be understood to include proteins having the characteristic two-armed, Y-shape of a typical antibody molecule as well as one or more fragments of an antibody that retain the ability to specifically bind to an antigen. Exemplary antibodies include, but are not limited to, a monoclonal antibody, a polyclonal antibody, a bi-specific antibody, a multispecific antibody, a grafted antibody, a human antibody, a humanized antibody, a synthetic antibody, a chimeric antibody, a camelized antibody, a single-chain Fvs (scFv) (including fragments in which the VL and VH are joined using recombinant methods by a synthetic or natural linker that enables them to be made as a single protein chain in which the VL and VH regions pair to form monovalent molecules, including single chain Fab and scFab), a single chain antibody, a Fab fragment (including monovalent fragments comprising the VL, VH, CL, and CHI domains), a F(ab')2 fragment (including bivalent fragments comprising two Fab fragments linked by a disulfide bridge at the hinge region), a Fd fragment (including fragments comprising the VH and CHI fragment), a Fv fragment (including fragments comprising the VL and VH domains of a single arm of an antibody), a single-domain antibody (dAb or sdAb) (including fragments comprising a VH domain), an isolated complementarity determining region (CDR), a diabody (including fragments comprising bivalent dimers such as two VL and VH domains bound to each other and recognizing two different antigens), a fragment comprised of only a single monomeric variable domain, disulfide-linked Fvs (sdFv), an intrabody, an anti-idiotypic (anti-Id) antibody, or ab antigen-binding fragments thereof. In some instances, the libraries disclosed herein comprise nucleic acids encoding for an immunoglobulin, wherein the immunoglobulin is a Fv antibody, including Fv antibodies comprised of the minimum antibody fragment which contains a complete antigen-recognition and antigen-binding site. In some embodiments, the Fv antibody consists of a dimer of one heavy chain and one light chain variable domain in tight, non-covalent association, and the three hypervariable regions of each variable domain interact to define an antigen-binding site on the surface of the VH-VL dimer. In some embodiments, the six hypervariable regions confer antigen-binding specificity to the antibody. In some embodiments, a single variable domain (or half of an Fv comprising only three hypervariable regions specific for an antigen, including single domain antibodies isolated from camelid animals comprising one heavy chain variable domain such as VHH antibodies or nanobodies) has the ability to recognize and bind antigen. In some instances, the libraries disclosed herein comprise nucleic acids encoding for an immunoglobulin, wherein the immunoglobulin is a single-chain Fv or scFv, including antibody fragments comprising a VH, a VL, or both a VH and VL domain, wherein both domains are present in a single polypeptide chain. In some embodiments, the Fv polypeptide further comprises a polypeptide linker between the VH and VL domains allowing the scFv to form the desired structure for antigen binding. In some instances, a scFv is linked to the Fc fragment or a VHH is linked to the Fc fragment (including minibodies). In some instances, the antibody comprises immunoglobulin molecules and immunologically active fragments of immunoglobulin molecules, e.g., molecules that contain an antigen binding site. Immunoglobulin molecules are of any type (e.g., IgG, IgE, IgM, IgD, IgA and IgY), class (e.g., IgG 1, IgG 2, IgG 3, IgG 4, IgA 1 and IgA 2), or subclass.

In some embodiments, libraries comprise immunoglobulins that are adapted to the species of an intended therapeutic target. Generally, these methods include “mammalization” and comprise methods for transferring donor antigen-binding information to a less immunogenic mammal antibody acceptor to generate useful therapeutic treatments. In some instances, the mammal is mouse, rat, equine, sheep, cow, primate (e.g., chimpanzee, baboon, gorilla, orangutan, monkey), dog, cat, pig, donkey, rabbit, or human. In some instances, provided herein are libraries and methods for felinization and caninization of antibodies.

“Humanized” forms of non-human antibodies can be chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. In some instances, these modifications are made to further refine antibody performance.

“Caninization” can comprise a method for transferring non-canine antigen-binding information from a donor antibody to a less immunogenic canine antibody acceptor to generate treatments useful as therapeutics in dogs. In some instances, caninized forms of non-canine antibodies provided herein are chimeric antibodies that contain minimal sequence derived from non-canine antibodies. In some instances, caninized antibodies are canine antibody sequences (“acceptor” or “recipient” antibody) in which hypervariable region residues of the recipient are replaced by hypervariable region residues from a non-canine species (“donor” antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the canine antibody are replaced by corresponding non-canine FR residues. In some instances, caninized antibodies include residues that are not found in the recipient antibody or in the donor antibody. In some instances, these modifications are made to further refine antibody performance. The caninized antibody may also comprise at least a portion of an immunoglobulin constant region (Fc) of a canine antibody.

“Felinization” can comprise a method for transferring non-feline antigen-binding information from a donor antibody to a less immunogenic feline antibody acceptor to generate treatments useful as therapeutics in cats. In some instances, felinized forms of non-feline antibodies provided herein are chimeric antibodies that contain minimal sequence derived from non-feline antibodies. In some instances, felinized antibodies are feline antibody sequences (“acceptor” or “recipient” antibody) in which hypervariable region residues of the recipient are replaced by hypervariable region residues from a non-feline species (“donor” antibody) such as mouse, rat, rabbit, cat, dogs, goat, chicken, bovine, horse, llama, camel, dromedaries, sharks, non-human primates, human, humanized, recombinant sequence, or an engineered sequence having the desired properties. In some instances, framework region (FR) residues of the feline antibody are replaced by corresponding non-feline FR residues. In some instances, felinized antibodies include residues that are not found in the recipient antibody or in the donor antibody. In some instances, these modifications are made to further refine antibody performance. The felinized antibody may also comprise at least a portion of an immunoglobulin constant region (Fc) of a felinize antibody.

Provided herein are libraries comprising nucleic acids encoding for a non-immunoglobulin. For example, the non-immunoglobulin is an antibody mimetic. Exemplary antibody mimetics include, but are not limited to, anticalins, affilins, affibody molecules, affimers, affitins, alphabodies, avimers, atrimers, DARPins, fynomers, Kunitz domain-based proteins, monobodies, anticalins, knottins, armadillo repeat protein-based proteins, and bicyclic peptides.

Libraries described herein comprising nucleic acids encoding for an immunoglobulin comprising variations in at least one region of the immunoglobulin. Exemplary regions of the antibody for variation include, but are not limited to, a complementarity-determining region (CDR), a variable domain, or a constant domain. In some instances, the CDR is CDR1, CDR2, or CDR3. In some instances, the CDR is a heavy domain including, but not limited to, CDRH1, CDRH2, and CDRH3. In some instances, the CDR is a light domain including, but not limited to, CDRL1, CDRL2, and CDRL3. In some instances, the variable domain is variable domain, light chain (VL) or variable domain, heavy chain (VH). In some instances, the VL domain comprises kappa or lambda chains. In some instances, the constant domain is constant domain, light chain (CL) or constant domain, heavy chain (CH).

Methods described herein provide for synthesis of libraries comprising nucleic acids encoding for an immunoglobulin, wherein each nucleic acid encodes for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the variant library comprises varied nucleic acids collectively encoding variations at multiple positions. In some instances, the variant library comprises sequences encoding for variation of at least a single codon of a CDRH1, CDRH2, CDRH3, CDRL1, CDRL2, CDRL3, VL, or VH domain. In some instances, the variant library comprises sequences encoding for variation of multiple codons of a CDRH1, CDRH2, CDRH3, CDRL1, CDRL2, CDRL3, VL, or VH domain. In some instances, the variant library comprises sequences encoding for variation of multiple codons of framework element 1 (FW1), framework element 2 (FW2), framework element 3 (FW3), or framework element 4 (FW4). An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

In some instances, the at least one region of the immunoglobulin for variation is from heavy chain V-gene family, heavy chain D-gene family, heavy chain J-gene family, light chain V-gene family, or light chain J-gene family. In some instances, the light chain V-gene family comprises immunoglobulin kappa (IGK) gene or immunoglobulin lambda (IGL). Exemplary genes include, but are not limited to, IGHV1-18, IGHV1-69, IGHV1-8, IGHV3-21, IGHV3-23, IGHV3-30/33rn, IGHV3-28, IGHV1-69, IGHV3-74, IGHV4-39, IGHV4-59/61, IGKV1-39, IGKV1-9, IGKV2-28, IGKV3-11, IGKV3-15, IGKV3-20, IGKV4-1, IGLV1-51, IGLV2-14, IGLV1-40, and IGLV3-1. In some instances, the gene is IGHV1-69, IGHV3-30, IGHV3-23, IGHV3, IGHV1-46, IGHV3-7, IGHV1, or IGHV1-8. In some instances, the gene is IGHV1-69 and IGHV3-30. In some instances, the gene is IGHJ3, IGHJ6, IGHJ, IGHJ4, IGHJ5, IGHJ2, or IGH1. In some instances, the gene is IGHJ3, IGHJ6, IGHJ, or IGHJ4.

Provided herein are libraries comprising nucleic acids encoding for immunoglobulins, wherein the libraries are synthesized with various numbers of fragments. In some instances, the fragments comprise the CDRH1, CDRH2, CDRH3, CDRL1, CDRL2, CDRL3, VL, or VH domain. In some instances, the fragments comprise framework element 1 (FW1), framework element 2 (FW2), framework element 3 (FW3), or framework element 4 (FW4). In some instances, the immunoglobulin libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

Libraries comprising nucleic acids encoding for immunoglobulins as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 amino acids to about 75 amino acids. In some instances, the immunoglobulins comprise at least or about 100, 200, 300, 400, 500, 600, 700, 800, 900, 1000, 2000, 3000, 4000, 5000, or more than 5000 amino acids.

A number of variant sequences for the at least one region of the immunoglobulin for variation are de novo synthesized using methods as described herein. In some instances, a number of variant sequences is de novo synthesized for CDRH1, CDRH2, CDRH3, CDRL1, CDRL2, CDRL3, VL, VH, or combinations thereof. In some instances, a number of variant sequences is de novo synthesized for framework element 1 (FW1), framework element 2 (FW2), framework element 3 (FW3), or framework element 4 (FW4). The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is at least or about 500, 600, 700, 800, 900, 1000, 2000, 3000, 4000, 5000, 6000, 7000, 8000, or more than 8000 sequences. In some instances, the number of variant sequences is about 10 to 500, 25 to 475, 50 to 450, 75 to 425, 100 to 400, 125 to 375, 150 to 350, 175 to 325, 200 to 300, 225 to 375, 250 to 350, or 275 to 325 sequences.

Variant sequences for the at least one region of the immunoglobulin, in some instances, vary in length or sequence. In some instances, the at least one region that is de novo synthesized is for CDRH1, CDRH2, CDRH3, CDRL1, CDRL2, CDRL3, VL, VH, or combinations thereof. In some instances, the at least one region that is de novo synthesized is for framework element 1 (FW1), framework element 2 (FW2), framework element 3 (FW3), or framework element 4 (FW4). In some instances, the variant sequence comprises at least or about 1, 2, 3, 4, 5, 6, 7, 8, 9, 10, 15, 20, 25, 30, 35, 40, 45, 50, or more than 50 variant nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 additional nucleotides or amino acids as compared to wild-type. In some instances, the variant sequence comprises at least or about 1, 2, 3, 4, 5, 6, 7, 8, 9, 10, 15, 20, 25, 30, 35, 40, 45, or 50 less nucleotides or amino acids as compared to wild-type. In some instances, the libraries comprise at least or about $10^1$, $10^2$, $10^3$, $10^4$, $10^5$, $10^6$, $10^7$, $10^8$, $10^9$, $10^{10}$, or more than $10^{10}$ variants.

Following synthesis of libraries described herein, libraries may be used for screening and analysis. For example, libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. In some instances, libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

In some instances, the libraries are assayed for functional activity, structural stability (e.g., thermal stable or pH stable), expression, specificity, or a combination thereof. In some instances, the libraries are assayed for immunoglobulin (e.g., an antibody) capable of folding. In some instances, a region of the antibody is assayed for functional activity, structural stability, expression, specificity, folding, or a combination thereof. For example, a VH region or VL region is assayed for functional activity, structural stability, expression, specificity, folding, or a combination thereof.

GLP1R Libraries

Provided herein are GLP1R binding libraries comprising nucleic acids encoding for immunoglobulins (e.g., antibodies) that bind to GLP1R. In some instances, the immunoglobulin sequences for GLP1R binding domains are determined by interactions between the GLP1R binding domains and the GLP1R.

Provided herein are libraries comprising nucleic acids encoding immunoglobulins comprising GLP1R binding domains, wherein the GLP1R binding domains are designed based on surface interactions on GLP1R. In some instances, the GLP1R comprises a sequence as defined by SEQ ID NO: 1. In some instances, the GLP1R binding domains interact with the amino- or carboxy-terminus of the GLP1R. In some instances, the GLP1R binding domains interact with at least one transmembrane domain including, but not limited to, transmembrane domain 1 (TM1), transmembrane domain 2 (TM2), transmembrane domain 3 (TM3), transmembrane domain 4 (TM4), transmembrane domain 5 (TM5), transmembrane domain 6 (TM6), and transmembrane domain 7 (TM7). In some instances, the GLP1R binding domains interact with an intracellular surface of the GLP1R. For example, the GLP1R binding domains interact with at least one intracellular loop including, but not limited to, intracellular loop 1 (ICL1), intracellular loop 2 (ICL2), and intracellular loop 3 (ICL3). In some instances, the GLP1R binding domains interact with an extracellular surface of the GLP1R. For example, the GLP1R binding domains interact with at least one extracellular domain (ECD) or extracellular loop (ECL) of the GLP1R. The extracellular loops include, but are not limited to, extracellular loop 1 (ECL1), extracellular loop 2 (ECL2), and extracellular loop 3 (ECL3).

Described herein are GLP1R binding domains, wherein the GLP1R binding domains are designed based on surface interactions between a GLP1R ligand and the GLP1R. In some instances, the ligand is a peptide. In some instances, the ligand is glucagon, glucagon-like peptide 1-(7-36) amide, glucagon-like peptide 1-(7-37), liraglutide, exendin-4, lixisenatide, T-0632, GLP1R0017, or BETP. In some instances, the ligand is a GLP1R agonist. In some instances, the ligand is a GLP1R antagonist. In some instances, the ligand is a GLP1R allosteric modulator. In some instances, the allosteric modulator is a negative allosteric modulator. In some instances, the allosteric modulator is a positive allosteric modulator.

Sequences of GLP1R binding domains based on surface interactions between a GLP1R ligand and the GLP1R are analyzed using various methods. For example, multispecies computational analysis is performed. In some instances, a structure analysis is performed. In some instances, a sequence analysis is performed. Sequence analysis can be performed using a database known in the art. Non-limiting examples of databases include, but are not limited to, NCBI BLAST (blast.ncbi.nlm.nih.gov/Blast.cgi), UCSC Genome Browser (genome.ucsc.edu/), UniProt (uniprot.org/), and IUPHAR/BPS Guide to PHARMACOLOGY (guidetopharmacology.org/).

Described herein are GLP1R binding domains designed based on sequence analysis among various organisms. For example, sequence analysis is performed to identify homologous sequences in different organisms. Exemplary organisms include, but are not limited to, mouse, rat, equine, sheep, cow, primate (e.g., chimpanzee, baboon, gorilla, orangutan, monkey), dog, cat, pig, donkey, rabbit, fish, fly, and human.

Following identification of GLP1R binding domains, libraries comprising nucleic acids encoding for the GLP1R binding domains may be generated. In some instances, libraries of GLP1R binding domains comprise sequences of GLP1R binding domains designed based on conformational ligand interactions, peptide ligand interactions, small molecule ligand interactions, extracellular domains of GLP1R, or antibodies that target GLP1R. In some instances, libraries of GLP1R binding domains comprise sequences of GLP1R binding domains designed based on peptide ligand interactions. Libraries of GLP1R binding domains may be translated to generate protein libraries. In some instances, libraries of GLP1R binding domains are translated to generate peptide libraries, immunoglobulin libraries, derivatives thereof, or combinations thereof. In some instances, libraries of GLP1R binding domains are translated to generate protein libraries that are further modified to generate peptidomimetic libraries. In some instances, libraries of GLP1R binding domains are translated to generate protein libraries that are used to generate small molecules.

Methods described herein provide for synthesis of libraries of GLP1R binding domains comprising nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the libraries of GLP1R binding domains comprise varied nucleic acids collectively encoding variations at multiple positions. In some instances, the variant library comprises sequences encoding for variation of at least a single codon in a GLP1R binding domain. In some instances, the variant library comprises sequences encoding for variation of multiple codons in a GLP1R binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of libraries comprising nucleic acids encoding for the GLP1R binding domains, wherein the libraries comprise sequences encoding for variation of length of the GLP1R binding domains. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Following identification of GLP1R binding domains, the GLP1R binding domains may be placed in immunoglobulins as described herein. In some instances, the GLP1R binding domains are placed in the CDRH3 region. GPCR binding domains that may be placed in immunoglobulins can also be referred to as a motif. Immunoglobulins comprising GLP1R binding domains may be designed based on binding, specificity, stability, expression, folding, or downstream activity. In some instances, the immunoglobulins comprising GLP1R binding domains enable contact with the GLP1R. In some instances, the immunoglobulins comprising GLP1R binding domains enables high affinity binding with the GLP1R. An exemplary amino acid sequence of GLP1R binding domain is described in Table 1.

TABLE 1

GLP1R amino acid sequences

| SEQ ID NO | GPCR | Amino Acid Sequence |
|---|---|---|
| 1352 | GLP1R | RPQGATVSLWETVQKWREYRRQCQRSLTEDPPPATDLFCNRTFDEYA CWPDGEPGSFVNVSCPWYLPWASSVPQGHVYRFCTAEGLWLQKDNS SLPWRDLSECEESKRGERSSPEEQLLFLYIIYTVGYALSFSALVIASAIL LGFRHLHCTRNYIHLNLFASFILRALSVFIKDAALKWMYSTAAQQHQ WDGLLSYQDSLSCRLVFLLMQYCVAANYYWLLVEGVYLYTLLAFSV LSEQWIFRLYVSIGWGVPLLFVVPWGIVKYLYEDEGCWTRNSNMNY WLIIRLPILFAIGVNFLIFVRVICIVVSKLKANLMCKTDIKCRLAKSTLT LIPLLGTHEVIFAFVMDEHARGTLRFIKLFTELSFTSFQGLMVAILYCF VNNEVQLEFRKSWERWRLEHLHIQRDSSMKPLKCPTSSLSSGATAGS SMYTATCQASCS |

Provided herein are immunoglobulins comprising GLP1R binding domains, wherein the sequences of the GLP1R binding domains support interaction with GLP1R. The sequence may be homologous or identical to a sequence of a GLP1R ligand. In some instances, the GLP1R binding domain sequence comprises at least or about 70%, 80%, 85%, 90%, 91%, 92%, 93%, 94%, 95%, 96%, 97%, 98%, 99%, or 100% sequence identity to SEQ ID NO: 1. In some instances, the GLP1R binding domain sequence comprises at least or about 95% homology to SEQ ID NO: 1. In some instances, the GLP1R binding domain sequence comprises at least or about 97% homology to SEQ ID NO: 1. In some instances, the GLP1R binding domain sequence comprises at least or about 99% homology to SEQ ID NO: 1. In some instances, the GLP1R binding domain sequence comprises at least or about 100% homology to SEQ ID NO: 1. In some instances, the GLP1R binding domain sequence comprises at least a portion having at least or about 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, or more than 400 amino acids of SEQ ID NO: 1.

The term "sequence identity" means that two polynucleotide sequences are identical (i.e., on a nucleotide-by-nucleotide basis) over the window of comparison. The term "percentage of sequence identity" is calculated by comparing two optimally aligned sequences over the window of comparison, determining the number of positions at which the identical nucleic acid base (e.g., A, T, C, G, U, or I) occurs in both sequences to yield the number of matched positions, dividing the number of matched positions by the total number of positions in the window of comparison (i.e., the window size), and multiplying the result by 100 to yield the percentage of sequence identity. Alignment for purposes of determining percent amino acid sequence identity can be achieved in various ways that are within the skill in the art, for instance, using publicly available computer software such as EMBOSS MATCHER, EMBOSS WATER, EMBOSS STRETCHER, EMBOSS NEEDLE, EMBOSS LALIGN, BLAST, BLAST-2, ALIGN or Megalign (DNASTAR) software.

Those skilled in the art can determine appropriate parameters for measuring alignment, including any algorithms needed to achieve maximal alignment over the full length of the sequences being compared.

In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows: 100 times the fraction X/Y, where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

The term "homology" or "similarity" between two proteins is determined by comparing the amino acid sequence and its conserved amino acid substitutes of one protein sequence to the second protein sequence. Similarity may be determined by procedures which are well-known in the art, for example, a BLAST program (Basic Local Alignment Search Tool at the National Center for Biological Information).

The terms "complementarity determining region," and "CDR," which are synonymous with "hypervariable region" or "HVR," are known in the art to refer to non-contiguous sequences of amino acids within antibody variable regions, which confer antigen specificity and/or binding affinity. In general, there are three CDRs in each heavy chain variable region (CDRH1, CDRH2, CDRH3) and three CDRs in each light chain variable region (CDRL1, CDRL2, CDRL3). "Framework regions" and "FR" are known in the art to refer to the non-CDR portions of the variable regions of the heavy and light chains. In general, there are four FRs in each full-length heavy chain variable region (FR-H1, FR-H2, FR-H3, and FR-H4), and four FRs in each full-length light chain variable region (FR-L1, FR-L2, FR-L3, and FR-L4). The precise amino acid sequence boundaries of a given CDR or FR can be readily determined using any of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273,927-948 ("Chothia" numbering scheme); MacCallum et al., J. Mol. Biol. 262:732-745 (1996), "Antibody-antigen interactions: Contact analysis and binding site topography," J. Mol. Biol. 262, 732-745." ("Contact" numbering scheme); Lefranc M P et al., "IMGT unique numbering for immunoglobulin and T cell receptor variable domains and Ig superfamily V-like domains," Dev Comp Immunol, 2003 January; 27 (1): 55-77 ("IMGT" numbering scheme); Honegger A and Plückthun A, "Yet another numbering scheme for immunoglobulin variable domains: an automatic modeling and analysis tool," J Mol Biol, 2001 Jun. 8; 309 (3): 657-70, ("Aho" numbering scheme); and Whitelegg N R and Rees A R, "WAM: an improved algorithm for modelling antibodies on the WEB," Protein Eng. 2000 December; 13 (12): 819-24 ("AbM" numbering scheme. In certain embodiments the CDRs of the antibodies described herein can be defined by a method selected from Kabat, Chothia, IMGT, Aho, AbM, or combinations thereof.

The boundaries of a given CDR or FR may vary depending on the scheme used for identification. For example, the Kabat scheme is based on structural alignments, while the Chothia scheme is based on structural information. Numbering for both the Kabat and Chothia schemes is based upon the most common antibody region sequence lengths, with insertions accommodated by insertion letters, for example, "30a," and deletions appearing in some antibodies. The two schemes place certain insertions and deletions ("indels") at different positions, resulting in differential numbering. The Contact scheme is based on analysis of complex crystal structures and is similar in many respects to the Chothia numbering scheme.

Provided herein are GLP1R binding libraries comprising nucleic acids encoding for immunoglobulins comprising GLP1R binding domains comprise variation in domain type, domain length, or residue variation. In some instances, the domain is a region in the immunoglobulin comprising the GLP1R binding domains. For example, the region is the VH, CDRH3, or VL domain. In some instances, the domain is the GLP1R binding domain.

Methods described herein provide for synthesis of a GLP1R binding library of nucleic acids each encoding for a predetermined variant of at least one predetermined reference nucleic acid sequence. In some cases, the predetermined reference sequence is a nucleic acid sequence encoding for a protein, and the variant library comprises sequences encoding for variation of at least a single codon such that a plurality of different variants of a single residue in the subsequent protein encoded by the synthesized nucleic acid are generated by standard translation processes. In some instances, the GLP1R binding library comprises varied nucleic acids collectively encoding variations at multiple positions. In some instances, the variant library comprises sequences encoding for variation of at least a single codon of a VH, CDRH3, or VL domain. In some instances, the variant library comprises sequences encoding for variation of at least a single codon in a GLP1R binding domain. For example, at least one single codon of a GLP1R binding domain as listed in Table 1 is varied. In some instances, the variant library comprises sequences encoding for variation of multiple codons of a VH, CDRH3, or VL domain. In some instances, the variant library comprises sequences encoding for variation of multiple codons in a GLP1R binding domain. An exemplary number of codons for variation include, but are not limited to, at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons.

Methods described herein provide for synthesis of a GLP1R binding library of nucleic acids each encoding for a predetermined variant of at least one predetermined reference nucleic acid sequence, wherein the GLP1R binding library comprises sequences encoding for variation of length of a domain. In some instances, the domain is VH, CDRH3, or VL domain. In some instances, the domain is the GLP1R binding domain. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 225, 250, 275, 300, or more than 300 codons less as compared to a predetermined reference sequence. In some instances, the library comprises sequences encoding for variation of length of at least or about 1, 5, 10, 15, 20, 25, 30, 35, 40, 45, 50, 55, 60, 65, 70, 75, 80, 85, 90, 95, 100, 125, 150, 175, 200, 225, 250, 275, 300, or more than 300 codons more as compared to a predetermined reference sequence.

Provided herein are GLP1R binding libraries comprising nucleic acids encoding for immunoglobulins comprising GLP1R binding domains, wherein the GLP1R binding libraries are synthesized with various numbers of fragments. In some instances, the fragments comprise the VH, CDRH3, or VL domain. In some instances, the GLP1R binding libraries are synthesized with at least or about 2 fragments, 3 fragments, 4 fragments, 5 fragments, or more than 5 fragments. The length of each of the nucleic acid fragments or average length of the nucleic acids synthesized may be at least or about 50, 75, 100, 125, 150, 175, 200, 225, 250, 275, 300, 325, 350, 375, 400, 425, 450, 475, 500, 525, 550, 575, 600, or more than 600 base pairs. In some instances, the length is about 50 to 600, 75 to 575, 100 to 550, 125 to 525, 150 to 500, 175 to 475, 200 to 450, 225 to 425, 250 to 400, 275 to 375, or 300 to 350 base pairs.

GLP1R binding libraries comprising nucleic acids encoding for immunoglobulins comprising GLP1R binding domains as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 to about 75 amino acids.

GLP1R binding libraries comprising de novo synthesized variant sequences encoding for immunoglobulins comprising GLP1R binding domains comprise a number of variant sequences. In some instances, a number of variant sequences is de novo synthesized for a CDRH1, CDRH2, CDRH3, CDRL1, CDRL2, CDRL3, VL, VH, or a combination thereof. In some instances, a number of variant sequences is de novo synthesized for framework element 1 (FW1), framework element 2 (FW2), framework element 3 (FW3), or framework element 4 (FW4). In some instances, a number of variant sequences is de novo synthesized for a GPCR binding domain. For example, the number of variant sequences is about 1 to about 10 sequences for the VH domain, about $10^8$ sequences for the GLP1R binding domain, and about 1 to about 44 sequences for the VK domain. The number of variant sequences may be at least or about 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, or more than 500 sequences. In some instances, the number of variant sequences is about 10 to 300, 25 to 275, 50 to 250, 75 to 225, 100 to 200, or 125 to 150 sequences.

Described herein are antibodies or antibody fragments thereof that binds GLP1R. In some embodiments, the antibody or antibody fragment thereof comprises a sequence as set forth in Tables 7-13. In some embodiments, the antibody or antibody fragment thereof comprises a sequence that is at least or about 70%, 80%, 85%, 90%, 91%, 92%, 93%, 94%, 95%, 96%, 97%, 98%, 99%, or 100% sequence identity to a sequence as set forth in Tables 7-13.

In some instances, an antibody or antibody fragment described herein comprises a CDRH1 sequence of any one of SEQ ID NOs: 441-619. In some instances, an antibody or antibody fragment described herein comprises a sequence that is at least 80% identical to a CDRH1 sequence of any one of SEQ ID NOs: 441-619. In some instances, an antibody or antibody fragment described herein comprises a sequence that is at least 85% identical to a CDRH1 sequence of any one of SEQ ID NOs: 441-619. In some instances, an antibody or antibody fragment described herein comprises a sequence that is at least 90% identical to a CDRH1 sequence of any one of SEQ ID NOs: 441-619. In some instances, an antibody or antibody fragment described herein comprises a sequence that is at least 95% identical to a CDRH1 sequence of any one of SEQ ID NOs: 441-619. In some instances, an antibody or antibody fragment described herein comprises a CDRH2 sequence of any one of SEQ ID NOs: 620-798. In some instances, an antibody or antibody fragment described herein comprises a sequence that is at least 80% identical to a CDRH2 sequence of any one of SEQ ID NOs: 620-798. In some instances, an antibody or antibody fragment described herein comprises a sequence that is at least 85% identical to a CDRH2 sequence of any one of SEQ ID NOs: 620-798. In some instances, an antibody or antibody fragment described herein comprises a sequence that is at least 90% identical to a CDRH2 sequence of any one of SEQ ID NOs: 620-798. In some instances, an antibody or antibody fragment described herein comprises a sequence that is at least 95% identical to a CDRH2 sequence of any one of SEQ ID NOs: 620-798. In some instances, an antibody or antibody fragment described herein comprises a CDRH3 sequence of any one of SEQ ID NOs: 799-977. In some instances, an antibody or antibody fragment described herein comprises a sequence that is at least 80% identical to a CDRH3 sequence of any one of SEQ ID NOs: 799-977. In some instances, an antibody or antibody fragment described herein comprises a sequence that is at least 85% identical to a CDRH3 sequence of any one of SEQ ID NOs: 799-977. In some instances, an antibody or antibody fragment described herein comprises a sequence that is at least 90% identical to a CDRH3 sequence of any one of SEQ ID NOs: 799-977. In some instances, an antibody or antibody fragment described herein comprises a sequence that is at least 95% identical to a CDRH3 sequence of any one of SEQ ID NOs: 799-977.

In some instances, an antibody or antibody fragment described herein comprises a CDRL1 sequence of any one of SEQ ID NOs: 978-1156. In some instances, an antibody or antibody fragment described herein comprises a sequence that is at least 80% identical to a CDRL1 sequence of any one of SEQ ID NOs: 978-1156. In some instances, an antibody or antibody fragment described herein comprises a sequence that is at least 85% identical to a CDRL1 sequence of any one of SEQ ID NOs: 978-1156. In some instances, an antibody or antibody fragment described herein comprises a sequence that is at least 90% identical to a CDRL1 sequence of any one of SEQ ID NOs: 978-1156. In some instances, an antibody or antibody fragment described herein comprises a sequence that is at least 95% identical to a CDRL1 sequence of any one of SEQ ID NOs: 978-1156. In some instances, an antibody or antibody fragment described herein comprises a CDRL2 sequence of any one of SEQ ID NOs: 1157-1335. In some instances, an antibody or antibody fragment described herein comprises a sequence that is at least 80% identical to a CDRL2 sequence of any one of SEQ ID NOs: 1157-1335. In some instances, an antibody or antibody fragment described herein comprises a sequence that is at least 85% identical to a CDRL2 sequence of any one of SEQ ID NOs: 1157-1335. In some instances, an antibody or antibody fragment described herein comprises a sequence that is at least 90% identical to a CDRL2 sequence of any one of SEQ ID NOs: 1157-1335. In some instances, an antibody or antibody fragment described herein comprises a sequence that is at least 95% identical to a CDRL2 sequence of any one of SEQ ID NOs: 1157-1335. In some instances, an antibody or antibody fragment described herein comprises a CDRL3 sequence of any one of SEQ ID NOs: 1336-1347 and 1353-1519. In some instances, an antibody or antibody fragment described herein comprises a sequence that is at least 80% identical to a CDRL3 sequence of any one of SEQ ID NOs: 1336-1347 and 1353-1519. In some instances, an antibody or antibody fragment described herein comprises a sequence that is at least 85% identical to a CDRL3 sequence of any one of SEQ ID NOs: 1336-1347 and 1353-1519. In some instances, an antibody or antibody fragment described herein comprises a sequence that is at least 90% identical to a CDRL3 sequence of any one of SEQ ID NOs: 1336-1347 and 1353-1519. In some instances, an antibody or antibody fragment described herein comprises a sequence that is at least 95% identical to a CDRL3 sequence of any one of SEQ ID NOs: 1336-1347 and 1353-1519.

In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 441-619; (b) an amino acid sequence of CDRH2 is as set forth in any one of SEQ ID NOs: 620-798; (c) an amino acid sequence of CDRH3 is as set forth in any one of SEQ ID NOs: 799-977; (d) an amino acid sequence of CDRL1 is as set forth in any one of SEQ ID NOs: 978-1156; (e) an amino acid sequence of CDRL2 is as set forth in any one of SEQ ID NOs: 1157-1335; and (f) an amino acid sequence of CDRL3 is as set forth in any one of SEQ ID NOs: 1336-1347 and 1353-1519. In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is at least or about 80%, 85%, 90%, or 95% identical to any one of SEQ ID NOs: 441-619; (b) an amino acid sequence of CDRH2 is at least or about 80%, 85%, 90%, or 95% identical to any one of SEQ ID NOs: 620-798; (c) an amino acid sequence of CDRH3 is at least or about 80%, 85%, 90%, or 95% identical to any one of SEQ ID NOs: 799-977; (d) an amino acid sequence of CDRL1 is at least or about 80%, 85%, 90%, or 95% identical to any one of SEQ ID NOs: 978-1156; (e) an amino acid sequence of CDRL2 is at least or about 80%, 85%, 90%, or 95% identical to any one of SEQ ID NOs: 1157-1335; and (f) an amino acid sequence of CDRL3 is at least or about 80%, 85%, 90%, or 95% identical to any one of SEQ ID NOs: 1336-1347 and 1353-1519.

Described herein, in some embodiments, are antibodies or antibody fragments comprising a variable domain, heavy chain region (VH) and a variable domain, light chain region (VL), wherein the VH comprises an amino acid sequence at least about 90% identical to a sequence as set forth in any one of SEQ ID NOs: 58-77, and wherein the VL comprises an amino acid sequence at least about 90% identical to a sequence as set forth in any one of SEQ ID NOs: 92-111. In some instances, the antibodies or antibody fragments comprise VH comprising at least or about 70%, 80%, 85%, 90%, 91%, 92%, 93%, 94%, 95%, 96%, 97%, 98%, 99%, or 100% sequence identity to any one of SEQ ID NOs: 58-77, and VL comprising at least or about 70%, 80%, 85%, 90%, 91%, 92%, 93%, 94%, 95%, 96%, 97%, 98%, 99%, or 100% sequence identity to any one of SEQ ID NOs: 92-111.

The term "sequence identity" means that two polynucleotide sequences are identical (i.e., on a nucleotide-by-nucleotide basis) over the window of comparison. The term "percentage of sequence identity" is calculated by comparing two optimally aligned sequences over the window of comparison, determining the number of positions at which the identical nucleic acid base (e.g., A, T, C, G, U, or I) occurs in both sequences to yield the number of matched positions, dividing the number of matched positions by the total number of positions in the window of comparison (i.e., the window size), and multiplying the result by 100 to yield the percentage of sequence identity. Typically, techniques for determining sequence identity include comparing two nucleotide or amino acid sequences and determining their percent identity. Sequence comparisons, such as for the purpose of assessing identities, may be performed by any suitable alignment algorithm, including but not limited to the Needleman-Wunsch algorithm (see, e.g., the EMBOSS Needle aligner available at ebi.ac.uk/Tools/psa/emboss-_needle/, optionally with default settings), the BLAST algorithm (see, e.g., the BLAST alignment tool available at blast.ncbi.nlm.nih.gov/Blast.cgi, optionally with default settings), and the Smith-Waterman algorithm (see, e.g., the EMBOSS Water aligner available at ebi.ac.uk/Tools/psa/emboss_water/, optionally with default settings). Optimal alignment may be assessed using any suitable parameters of a chosen algorithm, including default parameters. The "percent identity", also referred to as "percent homology", between two sequences may be calculated as the number of exact matches between two optimally aligned sequences divided by the length of the reference sequence and multiplied by 100. Percent identity may also be determined, for example, by comparing sequence information using the advanced BLAST computer program, including version 2.2.9, available from the National Institutes of Health. The BLAST program is based on the alignment method of Karlin and Altschul, Proc. Natl. Acad. Sci. USA 87:2264-2268 (1990) and as discussed in Altschul, et al., J. Mol. Biol. 215:403-410 (1990); Karlin and Altschul, Proc. Natl. Acad. Sci. USA 90:5873-5877 (1993); and Altschul et al., Nucleic Acids Res. 25:3389-3402 (1997). Briefly, the BLAST program defines identity as the number of identical aligned symbols (i.e., nucleotides or amino acids), divided by the total number of symbols in the shorter of the two sequences. The program may be used to determine percent identity over the entire length of the sequences being compared. Default parameters are provided to optimize searches with short query sequences, for example, with the blastp program. The program also allows use of an SEG filter to mask-off segments of the query sequences as determined by the SEG program of Wootton and Federhen, Computers and Chemistry 17:149-163 (1993). High sequence identity generally includes ranges of sequence identity of approximately 80% to 100% and integer values there between.

GLP1R binding libraries comprising de novo synthesized variant sequences encoding for immunoglobulins comprising GLP1R binding domains comprise improved diversity. For example, variants are generated by placing GLP1R binding domain variants in immunoglobulins comprising N-terminal CDRH3 variations and C-terminal CDRH3 variations. In some instances, variants include affinity maturation variants. Alternatively or in combination, variants include variants in other regions of the immunoglobulin including, but not limited to, CDRH1, CDRH2, CDRL1, CDRL2, and CDRL3. In some instances, the number of variants of the GLP1R binding libraries is at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ non-identical sequences. For example, a library comprising about 10 variant sequences for a VH region, about 237 variant sequences for a CDRH3 region, and about 43 variant sequences for a VL and CDRL3 region comprises $10^5$ non-identical sequences (10×237×43).

In some instances, the at least one region of the antibody for variation is from heavy chain V-gene family, heavy chain D-gene family, heavy chain J-gene family, light chain V-gene family, or light chain J-gene family. In some instances, the light chain V-gene family comprises immunoglobulin kappa (IGK) gene or immunoglobulin lambda (IGL). Exemplary regions of the antibody for variation include, but are not limited to, IGHV1-18, IGHV1-69, IGHV1-8, IGHV3-21, IGHV3-23, IGHV3-30/33rn, IGHV3-28, IGHV1-69, IGHV3-74, IGHV4-39, IGHV4-59/61, IGKV1-39, IGKV1-9, IGKV2-28, IGKV3-11, IGKV3-15, IGKV3-20, IGKV4-1, IGLV1-51, IGLV2-14, IGLV1-40, and IGLV3-1. In some instances, the gene is IGHV1-69, IGHV3-30, IGHV3-23, IGHV3, IGHV1-46, IGHV3-7, IGHV1, or IGHV1-8. In some instances, the gene is IGHV1-

69 and IGHV3-30. In some instances, the region of the antibody for variation is IGHJ3, IGHJ6, IGHJ, IGHJ4, IGHJ5, IGHJ2, or IGH1. In some instances, the region of the antibody for variation is IGHJ3, IGHJ6, IGHJ, or IGHJ4. In some instances, the at least one region of the antibody for variation is IGHV1-69, IGHV3-23, IGKV3-20, IGKV1-39, or combinations thereof. In some instances, the at least one region of the antibody for variation is IGHV1-69 and IGKV3-20, In some instances, the at least one region of the antibody for variation is IGHV1-69 and IGKV1-39. In some instances, the at least one region of the antibody for variation is IGHV3-23 and IGKV3-20. In some instances, the at least one region of the antibody for variation is IGHV3-23 and IGKV1-39.

Provided herein are libraries comprising nucleic acids encoding for a GLP1R antibody comprising variation in at least one region of the antibody, wherein the region is the CDR region. In some instances, the GLP1R antibody is a single domain antibody comprising one heavy chain variable domain such as a VHH antibody. In some instances, the VHH antibody comprises variation in one or more CDR regions. In some instances, libraries described herein comprise at least or about 1, 10, 20, 30, 40, 50, 60, 70, 80, 90, 100, 200, 300, 400, 500, 600, 700, 800, 900, 1000, 1200, 1400, 1600, 1800, 2000, 2400, 2600, 2800, 3000, or more than 3000 sequences of a CDR1, CDR2, or CDR3. In some instances, libraries described herein comprise at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences of a CDR1, CDR2, or CDR3. For example, the libraries comprise at least 2000 sequences of a CDR1, at least 1200 sequences for CDR2, and at least 1600 sequences for CDR3. In some instances, each sequence is non-identical.

In some instances, the CDR1, CDR2, or CDR3 is of a variable domain, light chain (VL). CDR1, CDR2, or CDR3 of a variable domain, light chain (VL) can be referred to as CDRL1, CDRL2, or CDRL3, respectively. In some instances, libraries described herein comprise at least or about 1, 2, 3, 4, 5, 6, 7, 8, 9, 10, 20, 30, 40, 50, 60, 70, 80, 90, 100, 200, 300, 400, 500, 600, 700, 800, 900, 1000, 1200, 1400, 1600, 1800, 2000, 2400, 2600, 2800, 3000, or more than 3000 sequences of a CDR1, CDR2, or CDR3 of the VL. In some instances, libraries described herein comprise at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences of a CDR1, CDR2, or CDR3 of the VL. For example, the libraries comprise at least 20 sequences of a CDR1 of the VL, at least 4 sequences of a CDR2 of the VL, and at least 140 sequences of a CDR3 of the VL. In some instances, the libraries comprise at least 2 sequences of a CDR1 of the VL, at least 1 sequence of CDR2 of the VL, and at least 3000 sequences of a CDR3 of the VL. In some instances, the VL is IGKV1-39, IGKV1-9, IGKV2-28, IGKV3-11, IGKV3-15, IGKV3-20, IGKV4-1, IGLV1-51, IGLV2-14, IGLV1-40, or IGLV3-1. In some instances, the VL is IGKV2-28. In some instances, the VL is IGLV1-51.

In some instances, the CDR1, CDR2, or CDR3 is of a variable domain, heavy chain (VH). CDR1, CDR2, or CDR3 of a variable domain, heavy chain (VH) can be referred to as CDRH1, CDRH2, or CDRH3, respectively. In some instances, libraries described herein comprise at least or about 1, 2, 3, 4, 5, 6, 7, 8, 9, 10, 20, 30, 40, 50, 60, 70, 80, 90, 100, 200, 300, 400, 500, 600, 700, 800, 900, 1000, 1200, 1400, 1600, 1800, 2000, 2400, 2600, 2800, 3000, or more than 3000 sequences of a CDR1, CDR2, or CDR3 of the VH. In some instances, libraries described herein comprise at least or about $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences of a CDR1, CDR2, or CDR3 of the VH. For example, the libraries comprise at least 30 sequences of a CDR1 of the VH, at least 570 sequences of a CDR2 of the VH, and at least $10^8$ sequences of a CDR3 of the VH. In some instances, the libraries comprise at least 30 sequences of a CDR1 of the VH, at least 860 sequences of a CDR2 of the VH, and at least $10^7$ sequences of a CDR3 of the VH. In some instances, the VH is IGHV1-18, IGHV1-69, IGHV1-8 IGHV3-21, IGHV3-23, IGHV3-30/33rn, IGHV3-28, IGHV3-74, IGHV4-39, or IGHV4-59/61. In some instances, the VH is IGHV1-69, IGHV3-30, IGHV3-23, IGHV3, IGHV1-46, IGHV3-7, IGHV1, or IGHV1-8. In some instances, the VH is IGHV1-69 or IGHV3-30. In some instances, the VH is IGHV3-23.

Libraries as described herein, in some embodiments, comprise varying lengths of a CDRL1, CDRL2, CDRL3, CDRH1, CDRH2, or CDRH3. In some instances, the length of the CDRL1, CDRL2, CDRL3, CDRH1, CDRH2, or CDRH3 comprises at least or about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, or more than 90 amino acids in length. For example, the CDRH3 comprises at least or about 12, 15, 16, 17, 20, 21, or 23 amino acids in length. In some instances, the CDRL1, CDRL2, CDRL3, CDRH1, CDRH2, or CDRH3 comprises a range of about 1 to about 10, about 5 to about 15, about 10 to about 20, or about 15 to about 30 amino acids in length.

Libraries comprising nucleic acids encoding for antibodies having variant CDR sequences as described herein comprise various lengths of amino acids when translated. In some instances, the length of each of the amino acid fragments or average length of the amino acid synthesized may be at least or about 15, 20, 25, 30, 35, 40, 45, 50, 55, 60, 65, 70, 75, 80, 85, 90, 95, 100, 105, 110, 115, 120, 125, 130, 135, 140, 145, 150, or more than 150 amino acids. In some instances, the length of the amino acid is about 15 to 150, 20 to 145, 25 to 140, 30 to 135, 35 to 130, 40 to 125, 45 to 120, 50 to 115, 55 to 110, 60 to 110, 65 to 105, 70 to 100, or 75 to 95 amino acids. In some instances, the length of the amino acid is about 22 amino acids to about 75 amino acids. In some instances, the antibodies comprise at least or about 100, 200, 300, 400, 500, 600, 700, 800, 900, 1000, 2000, 3000, 4000, 5000, or more than 5000 amino acids.

Ratios of the lengths of a CDRL1, CDRL2, CDRL3, CDRH1, CDRH2, or CDRH3 may vary in libraries described herein. In some instances, a CDRL1, CDRL2, CDRL3, CDRH1, CDRH2, or CDRH3 comprising at least or about 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, or more than 90 amino acids in length comprises about 10%, 20%, 30%, 40%, 50%, 60%, 70%, 80%, 90%, or more than 90% of the library. For example, a CDRH3 comprising about 23 amino acids in length is present in the library at 40%, a CDRH3 comprising about 21 amino acids in length is present in the library at 30%, a CDRH3 comprising about 17 amino acids in length is present in the library at 20%, and a CDRH3 comprising about 12 amino acids in length is present in the library at 10%. In some instances, a CDRH3 comprising about 20 amino acids in length is present in the library at 40%, a CDRH3 comprising about 16 amino acids in length is present in the library at 30%, a CDRH3 comprising about 15 amino acids in length is present in the library at 20%, and a CDRH3 comprising about 12 amino acids in length is present in the library at 10%.

Libraries as described herein encoding for a VHH antibody comprise variant CDR sequences that are shuffled to generate a library with a theoretical diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences. In some instances, the library has a final library diversity of at least or about $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, $10^{20}$, or more than $10^{20}$ sequences.

Provided herein are GLP1R binding libraries encoding for an immunoglobulin. In some instances, the GLP1R immunoglobulin is an antibody. In some instances, the GLP1R immunoglobulin is a VHH antibody. In some instances, the GLP1R immunoglobulin comprises a binding affinity (e.g., kD) to GLP1R of less than 1 nM, less than 1.2 nM, less than 2 nM, less than 5 nM, less than 10 nM, less than 11 nm, less than 13.5 nM, less than 15 nM, less than 20 nM, less than 25 nM, or less than 30 nM. In some instances, the GLP1R immunoglobulin comprises a kD of less than 1 nM. In some instances, the GLP1R immunoglobulin comprises a kD of less than 1.2 nM. In some instances, the GLP1R immunoglobulin comprises a kD of less than 2 nM. In some instances, the GLP1R immunoglobulin comprises a kD of less than 5 nM. In some instances, the GLP1R immunoglobulin comprises a kD of less than 10 nM. In some instances, the GLP1R immunoglobulin comprises a kD of less than 13.5 nM. In some instances, the GLP1R immunoglobulin comprises a kD of less than 15 nM. In some instances, the GLP1R immunoglobulin comprises a kD of less than 20 nM. In some instances, the GLP1R immunoglobulin comprises a kD of less than 25 nM. In some instances, the GLP1R immunoglobulin comprises a kD of less than 30 nM.

In some instances, the GLP1R immunoglobulin is a GLP1R agonist. In some instances, the GLP1R immunoglobulin is a GLP1R antagonist. In some instances, the GLP1R immunoglobulin is a GLP1R allosteric modulator. In some instances, the allosteric modulator is a negative allosteric modulator. In some instances, the allosteric modulator is a positive allosteric modulator. In some instances, the GLP1R immunoglobulin results in agonistic, antagonistic, or allosteric effects at a concentration of at least or about 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, 120 nM, 140 nM, 160 nM, 180 nM, 200 nM, 300 nM, 400 nM, 500 nM, 600 nM, 700 nM, 800 nM, 900 nM, 1000 nM, or more than 1000 nM. In some instances, the GLP1R immunoglobulin is a negative allosteric modulator. In some instances, the GLP1R immunoglobulin is a negative allosteric modulator at a concentration of at least or about 0.001, 0.005, 0.01, 0.05, 0.1, 0.5, 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, or more than 100 nM. In some instances, the GLP1R immunoglobulin is a negative allosteric modulator at a concentration in a range of about 0.001 to about 100, 0.01 to about 90, about 0.1 to about 80, 1 to about 50, about 10 to about 40 nM, or about 1 to about 10 nM. In some instances, the GLP1R immunoglobulin comprises an EC50 or IC50 of at least or about 0.001, 0.0025, 0.005, 0.01, 0.025, 0.05, 0.06, 0.07, 0.08, 0.9, 0.1, 0.5, 1, 2, 3, 4, 5, 6, or more than 6 nM. In some instances, the GLP1R immunoglobulin comprises an EC50 or IC50 of at least or about 1 nM, 2 nM, 4 nM, 6 nM, 8 nM, 10 nM, 20 nM, 30 nM, 40 nM, 50 nM, 60 nM, 70 nM, 80 nM, 90 nM, 100 nM, or more than 100 nM.

Provided herein are GLP1R binding libraries encoding for an immunoglobulin, wherein the immunoglobulin comprises a long half-life. In some instances, the half-life of the GLP1R immunoglobulin is at least or about 12 hours, 24 hours 36 hours, 48 hours, 60 hours, 72 hours, 84 hours, 96 hours, 108 hours, 120 hours, 140 hours, 160 hours, 180 hours, 200 hours, or more than 200 hours. In some instances, the half-life of the GLP1R immunoglobulin is in a range of about 12 hours to about 300 hours, about 20 hours to about 280 hours, about 40 hours to about 240 hours, or about 60 hours to about 200 hours.

GLP1R immunoglobulins as described herein may comprise improved properties. In some instances, the GLP1R immunoglobulins are monomeric. In some instances, the GLP1R immunoglobulins are not prone to aggregation. In some instances, at least or about 70%, 75%, 80%, 85%, 90%, 95%, or 99% of the GLP1R immunoglobulins are monomeric. In some instances, the GLP1R immunoglobulins are thermostable. In some instances, the GLP1R immunoglobulins result in reduced non-specific binding.

Following synthesis of GLP1R binding libraries comprising nucleic acids encoding immunoglobulins comprising GLP1R binding domains, libraries may be used for screening and analysis. For example, libraries are assayed for library displayability and panning. In some instances, displayability is assayed using a selectable tag. Exemplary tags include, but are not limited to, a radioactive label, a fluorescent label, an enzyme, a chemiluminescent tag, a colorimetric tag, an affinity tag or other labels or tags that are known in the art. In some instances, the tag is histidine, polyhistidine, myc, hemagglutinin (HA), or FLAG. In some instances, the GLP1R binding libraries comprises nucleic acids encoding immunoglobulins comprising GPCR binding domains with multiple tags such as GFP, FLAG, and Lucy as well as a DNA barcode. In some instances, libraries are assayed by sequencing using various methods including, but not limited to, single-molecule real-time (SMRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger) sequencing, +S sequencing, or sequencing by synthesis.

Expression Systems

Provided herein are libraries comprising nucleic acids encoding for immunoglobulins comprising GLP1R binding domains, wherein the libraries have improved specificity, stability, expression, folding, or downstream activity. In some instances, libraries described herein are used for screening and analysis.

Provided herein are libraries comprising nucleic acids encoding for immunoglobulins comprising GLP1R binding domains, wherein the nucleic acid libraries are used for screening and analysis. In some instances, screening and analysis comprise in vitro, in vivo, or ex vivo assays. Cells for screening include primary cells taken from living subjects or cell lines. Cells may be from prokaryotes (e.g., bacteria and fungi) or eukaryotes (e.g., animals and plants). Exemplary animal cells include, without limitation, those from a mouse, rabbit, primate, and insect. In some instances, cells for screening include a cell line including, but not limited to, Chinese Hamster Ovary (CHO) cell line, human embryonic kidney (HEK) cell line, or baby hamster kidney (BHK) cell line. In some instances, nucleic acid libraries described herein may also be delivered to a multicellular organism. Exemplary multicellular organisms include, without limitation, a plant, a mouse, rabbit, primate, and insect.

Nucleic acid libraries or protein libraries encoded thereof described herein may be screened for various pharmacological or pharmacokinetic properties. In some instances, the libraries are screened using in vitro assays, in vivo assays, or ex vivo assays. For example, in vitro pharmacological or pharmacokinetic properties that are screened include, but are not limited to, binding affinity, binding specificity, and binding avidity. Exemplary in vivo pharmacological or pharmacokinetic properties of libraries described herein that are screened include, but are not limited to, therapeutic efficacy, activity, preclinical toxicity properties, clinical efficacy properties, clinical toxicity properties, immunogenicity, potency, and clinical safety properties.

Pharmacological or pharmacokinetic properties that may be screened include, but are not limited to, cell binding affinity and cell activity. For example, cell binding affinity assays or cell activity assays are performed to determine agonistic, antagonistic, or allosteric effects of libraries described herein. In some instances, the cell activity assay is a cAMP assay. In some instances, libraries as described herein are compared to cell binding or cell activity of ligands of GLP1R.

Libraries as described herein may be screened in cell-based assays or in non-cell-based assays. Examples of non-cell-based assays include, but are not limited to, using viral particles, using in vitro translation proteins, and using protealiposomes with GLP1R.

Nucleic acid libraries as described herein may be screened by sequencing. In some instances, next generation sequence is used to determine sequence enrichment of GLP1R binding variants. In some instances, V gene distribution, J gene distribution, V gene family, CDR3 counts per length, or a combination thereof is determined. In some instances, clonal frequency, clonal accumulation, lineage accumulation, or a combination thereof is determined. In some instances, number of sequences, sequences with VH clones, clones, clones greater than 1, clonotypes, clonotypes greater than 1, lineages, simpsons, or a combination thereof is determined. In some instances, a percentage of non-identical CDR3s is determined. For example, the percentage of non-identical CDR3s is calculated as the number of non-identical CDR3s in a sample divided by the total number of sequences that had a CDR3 in the sample.

Provided herein are nucleic acid libraries, wherein the nucleic acid libraries may be expressed in a vector. Expression vectors for inserting nucleic acid libraries disclosed herein may comprise eukaryotic or prokaryotic expression vectors. Exemplary expression vectors include, without limitation, mammalian expression vectors: pSF-CMV-NEO-NH2-PPT-3×FLAG, pSF-CMV-NEO-COOH-3×FLAG, pSF-CMV-PURO-NH2-GST-TEV, pSF-OXB20-COOH-TEV-FLAG (R)-6His, pCEP4 pDEST27, pSF-CMV-Ub-KrYFP, pSF-CMV-FMDV-daGFP, pEF1a-mCherry-N1 Vector, pEF1a-tdTomato Vector, pSF-CMV-FMDV-Hygro, pSF-CMV-PGK-Puro, pMCP-tag(m), and pSF-CMV-PURO-NH2-CMYC; bacterial expression vectors: pSF-OXB20-BetaGal, pSF-OXB20-Fluc, pSF-OXB20, and pSF-Tac; plant expression vectors: pRI 101-AN DNA and pCambia2301; and yeast expression vectors: pTYB21 and pKLAC2, and insect vectors: pAc5.1/V5-His A and pDEST8. In some instances, the vector is pcDNA3 or pcDNA3.1.

Described herein are nucleic acid libraries that are expressed in a vector to generate a construct comprising an immunoglobulin comprising sequences of GLP1R binding domains. In some instances, a size of the construct varies. In some instances, the construct comprises at least or about 500, 600, 700, 800, 900, 1000, 1100, 1300, 1400, 1500, 1600, 1700, 1800, 2000, 2400, 2600, 2800, 3000, 3200, 3400, 3600, 3800, 4000, 4200, 4400, 4600, 4800, 5000, 6000, 7000, 8000, 9000, 10000, or more than 10000 bases. In some instances, a the construct comprises a range of about 300 to 1,000, 300 to 2,000, 300 to 3,000, 300 to 4,000, 300 to 5,000, 300 to 6,000, 300 to 7,000, 300 to 8,000, 300 to 9,000, 300 to 10,000, 1,000 to 2,000, 1,000 to 3,000, 1,000 to 4,000, 1,000 to 5,000, 1,000 to 6,000, 1,000 to 7,000, 1,000 to 8,000, 1,000 to 9,000, 1,000 to 10,000, 2,000 to 3,000, 2,000 to 4,000, 2,000 to 5,000, 2,000 to 6,000, 2,000 to 7,000, 2,000 to 8,000, 2,000 to 9,000, 2,000 to 10,000, 3,000 to 4,000, 3,000 to 5,000, 3,000 to 6,000, 3,000 to 7,000, 3,000 to 8,000, 3,000 to 9,000, 3,000 to 10,000, 4,000 to 5,000, 4,000 to 6,000, 4,000 to 7,000, 4,000 to 8,000, 4,000 to 9,000, 4,000 to 10,000, 5,000 to 6,000, 5,000 to 7,000, 5,000 to 8,000, 5,000 to 9,000, 5,000 to 10,000, 6,000 to 7,000, 6,000 to 8,000, 6,000 to 9,000, 6,000 to 10,000, 7,000 to 8,000, 7,000 to 9,000, 7,000 to 10,000, 8,000 to 9,000, 8,000 to 10,000, or 9,000 to 10,000 bases.

Provided herein are libraries comprising nucleic acids encoding for immunoglobulins comprising GPCR binding domains, wherein the nucleic acid libraries are expressed in a cell. In some instances, the libraries are synthesized to express a reporter gene. Exemplary reporter genes include, but are not limited to, acetohydroxyacid synthase (AHAS), alkaline phosphatase (AP), beta galactosidase (LacZ), beta glucoronidase (GUS), chloramphenicol acetyltransferase (CAT), green fluorescent protein (GFP), red fluorescent protein (RFP), yellow fluorescent protein (YFP), cyan fluorescent protein (CFP), cerulean fluorescent protein, citrine fluorescent protein, orange fluorescent protein, cherry fluorescent protein, turquoise fluorescent protein, blue fluorescent protein, horseradish peroxidase (HRP), luciferase (Luc), nopaline synthase (NOS), octopine synthase (OCS), luciferase, and derivatives thereof. Methods to determine modulation of a reporter gene are well known in the art, and include, but are not limited to, fluorometric methods (e.g. fluorescence spectroscopy, Fluorescence Activated Cell Sorting (FACS), fluorescence microscopy), and antibiotic resistance determination.

Diseases and Disorders

Provided herein are GLP1R binding libraries comprising nucleic acids encoding for immunoglobulins (e.g., antibodies) comprising GLP1R binding domains that may have therapeutic effects. In some instances, the GLP1R binding libraries result in protein when translated that is used to treat a disease or disorder. In some instances, the protein is an immunoglobulin. In some instances, the protein is a peptidomimetic.

GLP1R libraries as described herein may comprise modulators of GLP1R. In some instances, the modulator of GLP1R is an inhibitor. In some instances, the modulator of GLP1R is an activator. In some instances, the GLP1R inhibitor is a GLP1R antagonist. In some instances, the GLP1R antagonist is GLP1R-3. Modulators of GLP1R, in some instances, are used for treating various diseases or disorders.

Exemplary diseases include, but are not limited to, cancer, inflammatory diseases or disorders, a metabolic disease or disorder, a cardiovascular disease or disorder, a respiratory disease or disorder, pain, a digestive disease or disorder, a reproductive disease or disorder, an endocrine disease or disorder, or a neurological disease or disorder. In some instances, the cancer is a solid cancer or a hematologic cancer. In some instances, a modulator of GLP1R as described herein is used for treatment of weight gain (or for inducing weight loss), treatment of obesity, or treatment of Type II diabetes. In some instances, the GLP1R modulator is used for treating hypoglycemia. In some instances, the GLP1R modulator is used for treating post-bariatric hypoglycemia. In some instances, the GLP1R modulator is used for treating severe hypoglycemia. In some instances, the GLP1R modulator is used for treating hyperinsulinism. In some instances, the GLP1R modulator is used for treating congenital hyperinsulinism.

In some instances, the subject is a mammal. In some instances, the subject is a mouse, rabbit, dog, or human. Subjects treated by methods described herein may be infants, adults, or children. Pharmaceutical compositions comprising antibodies or antibody fragments as described herein may be administered intravenously or subcutaneously.

Described herein are pharmaceutical compositions comprising antibodies or antibody fragment thereof that binds GLP1R. In some embodiments, the antibody or antibody fragment thereof comprises a sequence as set forth in Tables 7-13. In some embodiments, the antibody or antibody fragment thereof comprises a sequence that is at least or about 70%, 80%, 85%, 90%, 91%, 92%, 93%, 94%, 95%, 96%, 97%, 98%, 99%, or 100% sequence identity to a sequence as set forth in Tables 7-13.

In some instances, a pharmaceutical composition comprises an antibody or antibody fragment described herein comprising a CDRH1 sequence of any one of SEQ ID NOs: 441-619. In some instances, a pharmaceutical composition comprises an antibody or antibody fragment described herein comprising a sequence that is at least 80% identical to a CDRH1 sequence of any one of SEQ ID NOs: 441-619. In some instances, a pharmaceutical composition comprises an antibody or antibody fragment described herein comprising a sequence that is at least 85% identical to a CDRH1 sequence of any one of SEQ ID NOs: 441-619. In some instances, a pharmaceutical composition comprises an antibody or antibody fragment described herein comprising a sequence that is at least 90% identical to a CDRH1 sequence of any one of SEQ ID NOs: 441-619. In some instances, a pharmaceutical composition comprises an antibody or antibody fragment described herein comprising a sequence that is at least 95% identical to a CDRH1 sequence of any one of SEQ ID NOs: 441-619. In some instances, a pharmaceutical composition comprises an antibody or antibody fragment described herein comprising a CDRH2 sequence of any one of SEQ ID NOs: 620-798. In some instances, a pharmaceutical composition comprises an antibody or antibody fragment described herein comprising a sequence that is at least 80% identical to a CDRH2 sequence of any one of SEQ ID NOs: 620-798. In some instances, a pharmaceutical composition comprises an antibody or antibody fragment described herein comprising a sequence that is at least 85% identical to a CDRH2 sequence of any one of SEQ ID NOs: 620-798. In some instances, a pharmaceutical composition comprises an antibody or antibody fragment described herein comprising a sequence that is at least 90% identical to a CDRH2 sequence of any one of SEQ ID NOs: 620-798. In some instances, a pharmaceutical composition comprises an antibody or antibody fragment described herein comprising a sequence that is at least 95% identical to a CDRH2 sequence of any one of SEQ ID NOs: 620-798. In some instances, a pharmaceutical composition comprises an antibody or antibody fragment described herein comprising a CDRH3 sequence of any one of SEQ ID NOs: 799-977. In some instances, a pharmaceutical composition comprises an antibody or antibody fragment described herein comprising a sequence that is at least 80% identical to a CDRH3 sequence of any one of SEQ ID NOs: 799-977. In some instances, a pharmaceutical composition comprises an antibody or antibody fragment described herein comprising a sequence that is at least 85% identical to a CDRH3 sequence of any one of SEQ ID NOs: 799-977. In some instances, a pharmaceutical composition comprises an antibody or antibody fragment described herein comprising a sequence that is at least 90% identical to a CDRH3 sequence of any one of SEQ ID NOs: 799-977. In some instances, a pharmaceutical composition comprises an antibody or antibody fragment described herein comprising a sequence that is at least 95% identical to a CDRH3 sequence of any one of SEQ ID NOs: 799-977.

In some instances, a pharmaceutical composition comprises an antibody or antibody fragment described herein comprising a CDRL1 sequence of any one of SEQ ID NOs: 978-1156. In some instances, a pharmaceutical composition comprises an antibody or antibody fragment described herein comprising a sequence that is at least 80% identical to a CDRL1 sequence of any one of SEQ ID NOs: 978-1156. In some instances, a pharmaceutical composition comprises an antibody or antibody fragment described herein comprising a sequence that is at least 85% identical to a CDRL1 sequence of any one of SEQ ID NOs: 978-1156. In some instances, a pharmaceutical composition comprises an antibody or antibody fragment described herein comprising a sequence that is at least 90% identical to a CDRL1 sequence of any one of SEQ ID NOs: 978-1156. In some instances, a pharmaceutical composition comprises an antibody or antibody fragment described herein comprising a sequence that is at least 95% identical to a CDRL1 sequence of any one of SEQ ID NOs: 978-1156. In some instances, a pharmaceutical composition comprises an antibody or antibody fragment described herein comprising a CDRL2 sequence of any one of SEQ ID NOS: 1157-1168. In some instances, a pharmaceutical composition comprises an antibody or antibody fragment described herein comprising a sequence that is at least 80% identical to a CDRL2 sequence of any one of SEQ ID NOs: 1157-1335. In some instances, a pharmaceutical composition comprises an antibody or antibody fragment described herein comprising a sequence that is at least 85% identical to a CDRL2 sequence of any one of SEQ ID NOs: 1157-1335. In some instances, a pharmaceutical composition comprises an antibody or antibody fragment described herein comprising a sequence that is at least 90% identical to a CDRL2 sequence of any one of SEQ ID NOs: 1157-1335. In some instances, a pharmaceutical composition comprises an antibody or antibody fragment described herein comprising a sequence that is at least 95% identical to a CDRL2 sequence of any one of SEQ ID NOs: 1157-1335. In some instances, a pharmaceutical composition comprises an antibody or antibody fragment described herein comprising a CDRL3 sequence of any one of SEQ ID NOs: 1336-1347 and 1353-1519. In some instances, a pharmaceutical composition comprises an antibody or antibody fragment described herein comprising a sequence that is at least 80% identical to a CDRL3 sequence of any one of SEQ ID NOs: 1336-1347 and 1353-1519. In some instances, a pharmaceutical composition comprises an antibody or antibody fragment described herein comprising a sequence that is at least 85% identical to a CDRL3 sequence of any one of SEQ ID NOs: 1336-1347 and 1353-1519. In some instances, a pharmaceutical composition comprises an antibody or antibody fragment described herein comprising a sequence that is at least 90% identical to a CDRL3 sequence of any one of SEQ ID NOs: 1336-1347 and 1353-1519. In some instances, a pharmaceutical composition comprises an antibody or antibody fragment described herein comprising a sequence that is at least 95% identical to a CDRL3 sequence of any one of SEQ ID NOs: 1336-1347 and 1353-1519.

In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is as set forth in any one of SEQ ID NOs: 441-619; (b) an amino acid sequence of CDRH2 is as set forth in any one of SEQ ID NOs: 620-798; (c) an amino acid sequence of CDRH3 is as set forth in any one of SEQ ID NOs: 799-977; (d) an amino acid sequence of CDRL1 is as set forth in any one of SEQ ID NOs: 978-1156; (e) an amino acid sequence of CDRL2 is as set forth in any one of SEQ ID NOs: 1157-1335; and (f) an amino acid sequence of CDRL3 is as set forth in any one of SEQ ID NOs: 1336-1347 and 1353-1519. In some embodiments, the antibody or antibody fragment comprising a variable domain, heavy chain region (VH) and a variable domain, light chain region (VL), wherein VH comprises complementarity determining regions CDRH1, CDRH2, and CDRH3, wherein VL comprises complementarity determining regions CDRL1, CDRL2, and CDRL3, and wherein (a) an amino acid sequence of CDRH1 is at least or about 80%, 85%, 90%, or 95% identical to any one of SEQ ID NOs: 441-619; (b) an amino acid sequence of CDRH2 is at least or about 80%, 85%, 90%, or 95% identical to any one of SEQ ID NOs: 620-798; (c) an amino acid sequence of CDRH3 is at least or about 80%, 85%, 90%, or 95% identical to any one of SEQ ID NOs: 799-977; (d) an amino acid sequence of CDRL1 is at least or about 80%, 85%, 90%, or 95% identical to any one of SEQ ID NOs: 978-1156; (e) an amino acid sequence of CDRL2 is at least or about 80%, 85%, 90%, or 95% identical to any one of SEQ ID NOs: 1157-1335; and (f) an amino acid sequence of CDRL3 is at least or about 80%, 85%, 90%, or 95% identical to any one of SEQ ID NOs: 1336-1347 and 1353-1519. Described herein, in some embodiments, are antibodies or antibody fragments comprising a variable domain, heavy chain region (VH) and a variable domain, light chain region (VL), wherein the VH comprises an amino acid sequence at least about 90% identical to a sequence as set forth in any one of SEQ ID NOs: 58-77, and wherein the VL comprises an amino acid sequence at least about 90% identical to a sequence as set forth in any one of SEQ ID NOs: 92-111. In some instances, the antibodies or antibody fragments comprise VH comprising at least or about 70%, 80%, 85%, 90%, 91%, 92%, 93%, 94%, 95%, 96%, 97%, 98%, 99%, or 100% sequence identity to any one of SEQ ID NOs: 58-77, and VL comprising at least or about 70%, 80%, 85%, 90%, 91%, 92%, 93%, 94%, 95%, 96%, 97%, 98%, 99%, or 100% sequence identity to any one of SEQ ID NOs: 92-111.

Described herein are pharmaceutical compositions comprising antibodies or antibody fragment thereof that binds GLP1R that comprise various dosages of the antibodies or antibody fragment. In some instances, the dosage is ranging from about 1 to 80 mg/kg, from about 1 to about 100 mg/kg, from about 5 to about 100 mg/kg, from about 5 to about 80 mg/kg, from about 5 to about 60 mg/kg, from about 5 to about 50 mg/kg or from about 5 to about 500 mg/kg which can be administered in single or multiple doses. In some instances, the dosage is administered in an amount of about 0.01 mg/kg, about 0.05 mg/kg, about 0.10 mg/kg, about 0.25 mg/kg, about 0.5 mg/kg, about 1 mg/kg, about 5 mg/kg, about 10 mg/kg, about 15 mg/kg, about 20 mg/kg, about 25 mg/kg, about 30 mg/kg, about 35 mg/kg, about 40 mg/kg, about 45 mg/kg, about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, about 100 mg/kg, about 105 mg/kg, about 110 mg/kg, about 115 mg/kg, about 120, about 125, about 130, about 135, about 140, about 145, about 150, about 155, about 160, about 165, about 170, about 175, about 180, about 185, about 190, about 195, about 200, about 205, about 210, about 215, about 220, about 225, about 230, about 240, about 250, about 260, about 270, about 275, about 280, about 290, about 300, about 310, about 320, about 330, about 340, about 350, about 360 mg/kg, about 370 mg/kg, about 380 mg/kg, about 390 mg/kg, about 400 mg/kg, 410 mg/kg, about 420 mg/kg, about 430 mg/kg, about 440 mg/kg, about 450 mg/kg, about 460 mg/kg, about 470 mg/kg, about 480 mg/kg, about 490 mg/kg, or about 500 mg/kg.

Variant Libraries

Codon Variation

Variant nucleic acid libraries described herein may comprise a plurality of nucleic acids, wherein each nucleic acid encodes for a variant codon sequence compared to a reference nucleic acid sequence. In some instances, each nucleic acid of a first nucleic acid population contains a variant at a single variant site. In some instances, the first nucleic acid population contains a plurality of variants at a single variant site such that the first nucleic acid population contains more than one variant at the same variant site. The first nucleic acid population may comprise nucleic acids collectively encoding multiple codon variants at the same variant site. The first nucleic acid population may comprise nucleic acids collectively encoding up to 19 or more codons at the same position. The first nucleic acid population may comprise nucleic acids collectively encoding up to 60 variant triplets at the same position, or the first nucleic acid population may comprise nucleic acids collectively encoding up to 61 different triplets of codons at the same position. Each variant may encode for a codon that results in a different amino acid during translation. Table 2 provides a listing of each codon possible (and the representative amino acid) for a variant site.

TABLE 2

List of codons and amino acids

| Amino Acids | One letter code | Three letter code | Codons | | | | | |
|---|---|---|---|---|---|---|---|---|
| Alanine | A | Ala | GCA | GCC | GCG | GCT | | |
| Cysteine | C | Cys | TGC | TGT | | | | |
| Aspartic acid | D | Asp | GAC | GAT | | | | |
| Glutamic acid | E | Glu | GAA | GAG | | | | |
| Phenylalanine | F | Phe | TTC | TTT | | | | |
| Glycine | G | Gly | GGA | GGC | GGG | GGT | | |
| Histidine | H | His | CAC | CAT | | | | |
| Isoleucine | I | Iso | ATA | ATC | ATT | | | |
| Lysine | K | Lys | AAA | AAG | | | | |
| Leucine | L | Leu | TTA | TTG | CTA | CTC | CTG | CTT |
| Methionine | M | Met | ATG | | | | | |
| Asparagine | N | Asn | AAC | AAT | | | | |
| Proline | P | Pro | CCA | CCC | CCG | CCT | | |
| Glutamine | Q | Gln | CAA | CAG | | | | |
| Arginine | R | Arg | AGA | AGG | CGA | CGC | CGG | CGT |
| Serine | S | Ser | AGC | AGT | TCA | TCC | TCG | TCT |
| Threonine | T | Thr | ACA | ACC | ACG | ACT | | |
| Valine | V | Val | GTA | GTC | GTG | GTT | | |
| Tryptophan | W | Trp | TGG | | | | | |
| Tyrosine | Y | Tyr | TAC | TAT | | | | |

A nucleic acid population may comprise varied nucleic acids collectively encoding up to 20 codon variations at multiple positions. In such cases, each nucleic acid in the population comprises variation for codons at more than one position in the same nucleic acid. In some instances, each nucleic acid in the population comprises variation for codons at 1, 2, 3, 4, 5, 6, 7, 8, 9, 10, 11, 12, 13, 14, 15, 16, 17, 18, 19, 20 or more codons in a single nucleic acid. In some instances, each variant long nucleic acid comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single long nucleic acid. In some instances, the variant nucleic acid population comprises variation for codons at 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more codons in a single nucleic acid. In some instances, the variant nucleic acid population comprises variation for codons in at least about 10, 20, 30, 40, 50, 60, 70, 80, 90, 100 or more codons in a single long nucleic acid.

Highly Parallel Nucleic Acid Synthesis

Provided herein is a platform approach utilizing miniaturization, parallelization, and vertical integration of the end-to-end process from polynucleotide synthesis to gene assembly within nanowells on silicon to create a revolutionary synthesis platform. Devices described herein provide, with the same footprint as a 96-well plate, a silicon synthesis platform capable of increasing throughput by a factor of up to 1,000 or more compared to traditional synthesis methods, with production of up to approximately 1,000,000 or more polynucleotides, or 10,000 or more genes in a single highly-parallelized run.

With the advent of next-generation sequencing, high resolution genomic data has become an important factor for studies that delve into the biological roles of various genes in both normal biology and disease pathogenesis. At the core of this research is the central dogma of molecular biology and the concept of "residue-by-residue transfer of sequential information." Genomic information encoded in the DNA is transcribed into a message that is then translated into the protein that is the active product within a given biological pathway.

Another exciting area of study is on the discovery, development and manufacturing of therapeutic molecules focused on a highly-specific cellular target. High diversity DNA sequence libraries are at the core of development pipelines for targeted therapeutics. Gene mutants are used to express proteins in a design, build, and test protein engineering cycle that ideally culminates in an optimized gene for high expression of a protein with high affinity for its therapeutic target. As an example, consider the binding pocket of a receptor. The ability to test all sequence permutations of all residues within the binding pocket simultaneously will allow for a thorough exploration, increasing chances of success. Saturation mutagenesis, in which a researcher attempts to generate all possible mutations at a specific site within the receptor, represents one approach to this development challenge. Though costly and time- and labor-intensive, it enables each variant to be introduced into each position. In contrast, combinatorial mutagenesis, where a few selected positions or short stretch of DNA may be modified extensively, generates an incomplete repertoire of variants with biased representation.

To accelerate the drug development pipeline, a library with the desired variants available at the intended frequency in the right position available for testing—in other words, a precision library—enables reduced costs as well as turnaround time for screening. Provided herein are methods for synthesizing nucleic acid synthetic variant libraries which provide for precise introduction of each intended variant at the desired frequency. To the end user, this translates to the ability to not only thoroughly sample sequence space but also be able to query these hypotheses in an efficient manner, reducing cost and screening time. Genome-wide editing can elucidate important pathways, libraries where each variant and sequence permutation can be tested for optimal functionality, and thousands of genes can be used to reconstruct entire pathways and genomes to re-engineer biological systems for drug discovery.

In a first example, a drug itself can be optimized using methods described herein. For example, to improve a specified function of an antibody, a variant polynucleotide library encoding for a portion of the antibody is designed and synthesized. A variant nucleic acid library for the antibody can then be generated by processes described herein (e.g., PCR mutagenesis followed by insertion into a vector). The antibody is then expressed in a production cell line and screened for enhanced activity. Example screens include examining modulation in binding affinity to an antigen, stability, or effector function (e.g., ADCC, complement, or apoptosis). Exemplary regions to optimize the antibody include, without limitation, the Fc region, Fab region, variable region of the Fab region, constant region of the Fab region, variable domain of the heavy chain or light chain ($V_H$ or $V_L$), and specific complementarity-determining regions (CDRs) of $V_H$ or $V_L$.

Nucleic acid libraries synthesized by methods described herein may be expressed in various cells associated with a disease state. Cells associated with a disease state include cell lines, tissue samples, primary cells from a subject, cultured cells expanded from a subject, or cells in a model system. Exemplary model systems include, without limitation, plant and animal models of a disease state.

To identify a variant molecule associated with prevention, reduction or treatment of a disease state, a variant nucleic acid library described herein is expressed in a cell associated with a disease state, or one in which a cell a disease state can be induced. In some instances, an agent is used to induce a disease state in cells. Exemplary tools for disease state induction include, without limitation, a Cre/Lox recombination system, LPS inflammation induction, and streptozotocin to induce hypoglycemia. The cells associated with a disease state may be cells from a model system or cultured cells, as well as cells from a subject having a particular disease condition. Exemplary disease conditions include a bacterial, fungal, viral, autoimmune, or proliferative disorder (e.g., cancer). In some instances, the variant nucleic acid library is expressed in the model system, cell line, or primary cells derived from a subject, and screened for changes in at least one cellular activity. Exemplary cellular activities include, without limitation, proliferation, cycle progression, cell death, adhesion, migration, reproduction, cell signaling, energy production, oxygen utilization, metabolic activity, and aging, response to free radical damage, or any combination thereof.

Substrates

Devices used as a surface for polynucleotide synthesis may be in the form of substrates which include, without limitation, homogenous array surfaces, patterned array surfaces, channels, beads, gels, and the like. Provided herein are substrates comprising a plurality of clusters, wherein each cluster comprises a plurality of loci that support the attachment and synthesis of polynucleotides. In some instances, substrates comprise a homogenous array surface. For example, the homogenous array surface is a homogenous plate. The term "locus" as used herein refers to a discrete region on a structure which provides support for polynucleotides encoding for a single predetermined sequence to extend from the surface. In some instances, a locus is on a two-dimensional surface, e.g., a substantially planar surface. In some instances, a locus is on a three-dimensional surface, e.g., a well, microwell, channel, or post. In some instances, a surface of a locus comprises a material that is actively functionalized to attach to at least one nucleotide for polynucleotide synthesis, or preferably, a population of identical nucleotides for synthesis of a population of polynucleotides. In some instances, polynucleotide refers to a population of polynucleotides encoding for the same nucleic acid sequence. In some cases, a surface of a substrate is inclusive of one or a plurality of surfaces of a substrate. The average error rates for polynucleotides synthesized within a library described here using the systems and methods provided are often less than 1 in 1000, less than about 1 in 2000, less than about 1 in 3000 or less often without error correction.

Provided herein are surfaces that support the parallel synthesis of a plurality of polynucleotides having different predetermined sequences at addressable locations on a common support. In some instances, a substrate provides support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more non-identical polynucleotides. In some cases, the surfaces provide support for the synthesis of more than 50, 100, 200, 400, 600, 800, 1000, 1200, 1400, 1600, 1800, 2,000; 5,000; 10,000; 20,000; 50,000; 100,000; 200,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; 10,000,000 or more polynucleotides encoding for distinct sequences. In some instances, at least a portion of the polynucleotides have an identical sequence or are configured to be synthesized with an identical sequence. In some instances, the substrate provides a surface environment for the growth of polynucleotides having at least 80, 90, 100, 120, 150, 175, 200, 225, 250, 275, 300, 325, 350, 375, 400, 425, 450, 475, 500 bases or more.

Provided herein are methods for polynucleotide synthesis on distinct loci of a substrate, wherein each locus supports the synthesis of a population of polynucleotides. In some cases, each locus supports the synthesis of a population of polynucleotides having a different sequence than a population of polynucleotides grown on another locus. In some instances, each polynucleotide sequence is synthesized with 1, 2, 3, 4, 5, 6, 7, 8, 9 or more redundancy across different loci within the same cluster of loci on a surface for polynucleotide synthesis. In some instances, the loci of a substrate are located within a plurality of clusters. In some instances, a substrate comprises at least 10, 500, 1000, 2000, 3000, 4000, 5000, 6000, 7000, 8000, 9000, 10000, 11000, 12000, 13000, 14000, 15000, 20000, 30000, 40000, 50000 or more clusters. In some instances, a substrate comprises more than 2,000; 5,000; 10,000; 100,000; 200,000; 300,000; 400,000; 500,000; 600,000; 700,000; 800,000; 900,000; 1,000,000; 1,100,000; 1,200,000; 1,300,000; 1,400,000; 1,500,000; 1,600,000; 1,700,000; 1,800,000; 1,900,000; 2,000,000; 300,000; 400,000; 500,000; 600,000; 700,000; 800,000; 900,000; 1,000,000; 1,200,000; 1,400,000; 1,600,000; 1,800,000; 2,000,000; 2,500,000; 3,000,000; 3,500,000; 4,000,000; 4,500,000; 5,000,000; or 10,000,000 or more distinct loci. In some instances, a substrate comprises about 10,000 distinct loci. The amount of loci within a single cluster is varied in different instances. In some cases, each cluster includes 1, 2, 3, 4, 5, 6, 7, 8, 9, 10, 20, 30, 40, 50, 60, 70, 80, 90, 100, 120, 130, 150, 200, 300, 400, 500 or more loci. In some instances, each cluster includes about 50-500 loci. In some instances, each cluster includes about 100-200 loci. In some instances, each cluster includes about 100-150 loci. In some instances, each cluster includes about 109, 121, 130 or 137 loci. In some instances, each cluster includes about 19, 20, 61, 64 or more loci. Alternatively or in combination, polynucleotide synthesis occurs on a homogenous array surface.

In some instances, the number of distinct polynucleotides synthesized on a substrate is dependent on the number of distinct loci available in the substrate. In some instances, the density of loci within a cluster or surface of a substrate is at least or about 1, 10, 25, 50, 65, 75, 100, 130, 150, 175, 200, 300, 400, 500, 1,000 or more loci per $mm^2$. In some cases, a substrate comprises 10-500, 25-400, 50-500, 100-500, 150-500, 10-250, 50-250, 10-200, or 50-200 $mm^2$. In some instances, the distance between the centers of two adjacent loci within a cluster or surface is from about 10-500, from about 10-200, or from about 10-100 um. In some instances, the distance between two centers of adjacent loci is greater than about 10, 20, 30, 40, 50, 60, 70, 80, 90 or 100 um. In some instances, the distance between the centers of two adjacent loci is less than about 200, 150, 100, 80, 70, 60, 50, 40, 30, 20 or 10 um. In some instances, each locus has a width of about 0.5, 1, 2, 3, 4, 5, 6, 7, 8, 9, 10, 20, 30, 40, 50, 60, 70, 80, 90 or 100 um. In some cases, each locus has a width of about 0.5-100, 0.5-50, 10-75, or 0.5-50 um.

In some instances, the density of clusters within a substrate is at least or about 1 cluster per 100 $mm^2$, 1 cluster per 10 $mm^2$, 1 cluster per 5 $mm^2$, 1 cluster per 4 $mm^2$, 1 cluster per 3 $mm^2$, 1 cluster per 2 $mm^2$, 1 cluster per 1 $mm^2$, 2 clusters per 1 $mm^2$, 3 clusters per 1 $mm^2$, 4 clusters per 1 $mm^2$, 5 clusters per 1 $mm^2$, 10 clusters per 1 $mm^2$, 50 clusters per 1 $mm^2$ or more. In some instances, a substrate comprises from about 1 cluster per 10 $mm^2$ to about 10 clusters per 1 $mm^2$. In some instances, the distance between the centers of two adjacent clusters is at least or about 50, 100, 200, 500, 1000, 2000, or 5000 um. In some cases, the distance between the centers of two adjacent clusters is between about 50-100, 50-200, 50-300, 50-500, and 100-2000 um. In some cases, the distance between the centers of two adjacent clusters is between about 0.05-50, 0.05-10, 0.05-5, 0.05-4, 0.05-3, 0.05-2, 0.1-10, 0.2-10, 0.3-10, 0.4-10, 0.5-10, 0.5-5, or 0.5-2 mm. In some cases, each cluster has a cross section of about 0.5 to about 2, about 0.5 to about 1, or about 1 to about 2 mm. In some cases, each cluster has a cross section of about 0.5, 0.6, 0.7, 0.8, 0.9, 1, 1.1, 1.2, 1.3, 1.4, 1.5, 1.6, 1.7, 1.8, 1.9 or 2 mm. In some cases, each cluster has an interior cross section of about 0.5, 0.6, 0.7, 0.8, 0.9, 1, 1.1, 1.15, 1.2, 1.3, 1.4, 1.5, 1.6, 1.7, 1.8, 1.9 or 2 mm.

In some instances, a substrate is about the size of a standard 96 well plate, for example between about 100 and about 200 mm by between about 50 and about 150 mm. In some instances, a substrate has a diameter less than or equal to about 1000, 500, 450, 400, 300, 250, 200, 150, 100 or 50 mm. In some instances, the diameter of a substrate is between about 25-1000, 25-800, 25-600, 25-500, 25-400, 25-300, or 25-200 mm. In some instances, a substrate has a planar surface area of at least about 100; 200; 500; 1,000; 2,000; 5,000; 10,000; 12,000; 15,000; 20,000; 30,000;

40,000; 50,000 $mm^2$ or more. In some instances, the thickness of a substrate is between about 50-2000, 50-1000, 100-1000, 200-1000, or 250-1000 mm.

Surface Materials

Substrates, devices, and reactors provided herein are fabricated from any variety of materials suitable for the methods, compositions, and systems described herein. In certain instances, substrate materials are fabricated to exhibit a low level of nucleotide binding. In some instances, substrate materials are modified to generate distinct surfaces that exhibit a high level of nucleotide binding. In some instances, substrate materials are transparent to visible and/or UV light. In some instances, substrate materials are sufficiently conductive, e.g., are able to form uniform electric fields across all or a portion of a substrate. In some instances, conductive materials are connected to an electric ground. In some instances, the substrate is heat conductive or insulated. In some instances, the materials are chemical resistant and heat resistant to support chemical or biochemical reactions, for example polynucleotide synthesis reaction processes. In some instances, a substrate comprises flexible materials. For flexible materials, materials can include, without limitation: nylon, both modified and unmodified, nitrocellulose, polypropylene, and the like. In some instances, a substrate comprises rigid materials. For rigid materials, materials can include, without limitation: glass; fuse silica; silicon, plastics (for example polytetraflouroethylene, polypropylene, polystyrene, polycarbonate, and blends thereof, and the like); and metals (for example, gold, platinum, and the like). The substrate, solid support or reactors can be fabricated from a material selected from the group consisting of silicon, polystyrene, agarose, dextran, cellulosic polymers, polyacrylamides, polydimethylsiloxane (PDMS), and glass. The substrates/solid supports or the microstructures/reactors therein may be manufactured with a combination of materials listed herein or any other suitable material known in the art.

Surface Architecture

Provided herein are substrates for the methods, compositions, and systems described herein, wherein the substrates have a surface architecture suitable for the methods, compositions, and systems described herein. In some instances, a substrate comprises raised and/or lowered features. One benefit of having such features is an increase in surface area to support polynucleotide synthesis. In some instances, a substrate having raised and/or lowered features is referred to as a three-dimensional substrate. In some cases, a three-dimensional substrate comprises one or more channels. In some cases, one or more loci comprise a channel. In some cases, the channels are accessible to reagent deposition via a deposition device such as a material deposition device. In some cases, reagents and/or fluids collect in a larger well in fluid communication one or more channels. For example, a substrate comprises a plurality of channels corresponding to a plurality of loci with a cluster, and the plurality of channels are in fluid communication with one well of the cluster. In some methods, a library of polynucleotides is synthesized in a plurality of loci of a cluster.

Provided herein are substrates for the methods, compositions, and systems described herein, wherein the substrates are configured for polynucleotide synthesis. In some instances, the structure is configured to allow for controlled flow and mass transfer paths for polynucleotide synthesis on a surface. In some instances, the configuration of a substrate allows for the controlled and even distribution of mass transfer paths, chemical exposure times, and/or wash efficacy during polynucleotide synthesis. In some instances, the configuration of a substrate allows for increased sweep efficiency, for example by providing sufficient volume for a growing polynucleotide such that the excluded volume by the growing polynucleotide does not take up more than 50, 45, 40, 35, 30, 25, 20, 15, 14, 13, 12, 11, 10, 9, 8, 7, 6, 5, 4, 3, 2, 1%, or less of the initially available volume that is available or suitable for growing the polynucleotide. In some instances, a three-dimensional structure allows for managed flow of fluid to allow for the rapid exchange of chemical exposure.

Provided herein are substrates for the methods, compositions, and systems described herein, wherein the substrates comprise structures suitable for the methods, compositions, and systems described herein. In some instances, segregation is achieved by physical structure. In some instances, segregation is achieved by differential functionalization of the surface generating active and passive regions for polynucleotide synthesis. In some instances, differential functionalization is achieved by alternating the hydrophobicity across the substrate surface, thereby creating water contact angle effects that cause beading or wetting of the deposited reagents. Employing larger structures can decrease splashing and cross-contamination of distinct polynucleotide synthesis locations with reagents of the neighboring spots. In some cases, a device, such as a material deposition device, is used to deposit reagents to distinct polynucleotide synthesis locations. Substrates having three-dimensional features are configured in a manner that allows for the synthesis of a large number of polynucleotides (e.g., more than about 10,000) with a low error rate (e.g., less than about 1:500, 1:1000, 1:1500, 1:2,000, 1:3,000, 1:5,000, or 1:10,000). In some cases, a substrate comprises features with a density of about or greater than about 1, 5, 10, 20, 30, 40, 50, 60, 70, 80, 100, 110, 120, 130, 140, 150, 160, 170, 180, 190, 200, 300, 400 or 500 features per $mm^2$.

A well of a substrate may have the same or different width, height, and/or volume as another well of the substrate. A channel of a substrate may have the same or different width, height, and/or volume as another channel of the substrate. In some instances, the diameter of a cluster or the diameter of a well comprising a cluster, or both, is between about 0.05-50, 0.05-10, 0.05-5, 0.05-4, 0.05-3, 0.05-2, 0.05-1, 0.05-0.5, 0.05-0.1, 0.1-10, 0.2-10, 0.3-10, 0.4-10, 0.5-10, 0.5-5, or 0.5-2 mm. In some instances, the diameter of a cluster or well or both is less than or about 5, 4, 3, 2, 1, 0.5, 0.1, 0.09, 0.08, 0.07, 0.06, or 0.05 mm. In some instances, the diameter of a cluster or well or both is between about 1.0 and 1.3 mm. In some instances, the diameter of a cluster or well, or both is about 1.150 mm. In some instances, the diameter of a cluster or well, or both is about 0.08 mm. The diameter of a cluster refers to clusters within a two-dimensional or three-dimensional substrate.

In some instances, the height of a well is from about 20-1000, 50-1000, 100-1000, 200-1000, 300-1000, 400-1000, or 500-1000 um. In some cases, the height of a well is less than about 1000, 900, 800, 700, or 600 um.

In some instances, a substrate comprises a plurality of channels corresponding to a plurality of loci within a cluster, wherein the height or depth of a channel is 5-500, 5-400, 5-300, 5-200, 5-100, 5-50, or 10-50 um. In some cases, the height of a channel is less than 100, 80, 60, 40, or 20 um.

In some instances, the diameter of a channel, locus (e.g., in a substantially planar substrate) or both channel and locus (e.g., in a three-dimensional substrate wherein a locus corresponds to a channel) is from about 1-1000, 1-500, 1-200, 1-100, 5-100, or 10-100 um, for example, to about 90, 80, 70, 60, 50, 40, 30, 20 or 10 um. In some instances, the diameter of a channel, locus, or both channel and locus is less than about 100, 90, 80, 70, 60, 50, 40, 30, 20 or 10 um. In some instances, the distance between the center of two adjacent channels, loci, or channels and loci is from about 1-500, 1-200, 1-100, 5-200, 5-100, 5-50, or 5-30, for example, to about 20 um.

Surface Modifications

Provided herein are methods for polynucleotide synthesis on a surface, wherein the surface comprises various surface modifications. In some instances, the surface modifications are employed for the chemical and/or physical alteration of a surface by an additive or subtractive process to change one or more chemical and/or physical properties of a substrate surface or a selected site or region of a substrate surface. For example, surface modifications include, without limitation, (1) changing the wetting properties of a surface, (2) functionalizing a surface, i.e., providing, modifying or substituting surface functional groups, (3) defunctionalizing a surface, i.e., removing surface functional groups, (4) otherwise altering the chemical composition of a surface, e.g., through etching, (5) increasing or decreasing surface roughness, (6) providing a coating on a surface, e.g., a coating that exhibits wetting properties that are different from the wetting properties of the surface, and/or (7) depositing particulates on a surface.

In some cases, the addition of a chemical layer on top of a surface (referred to as adhesion promoter) facilitates structured patterning of loci on a surface of a substrate. Exemplary surfaces for application of adhesion promotion include, without limitation, glass, silicon, silicon dioxide and silicon nitride. In some cases, the adhesion promoter is a chemical with a high surface energy. In some instances, a second chemical layer is deposited on a surface of a substrate. In some cases, the second chemical layer has a low surface energy. In some cases, surface energy of a chemical layer coated on a surface supports localization of droplets on the surface. Depending on the patterning arrangement selected, the proximity of loci and/or area of fluid contact at the loci are alterable.

In some instances, a substrate surface, or resolved loci, onto which nucleic acids or other moieties are deposited, e.g., for polynucleotide synthesis, are smooth or substantially planar (e.g., two-dimensional) or have irregularities, such as raised or lowered features (e.g., three-dimensional features). In some instances, a substrate surface is modified with one or more different layers of compounds. Such modification layers of interest include, without limitation, inorganic and organic layers such as metals, metal oxides, polymers, small organic molecules, and the like.

In some instances, resolved loci of a substrate are functionalized with one or more moieties that increase and/or decrease surface energy. In some cases, a moiety is chemically inert. In some cases, a moiety is configured to support a desired chemical reaction, for example, one or more processes in a polynucleotide synthesis reaction. The surface energy, or hydrophobicity, of a surface is a factor for determining the affinity of a nucleotide to attach onto the surface. In some instances, a method for substrate functionalization comprises: (a) providing a substrate having a surface that comprises silicon dioxide; and (b) silanizing the surface using a suitable silanizing agent described herein or otherwise known in the art, for example, an organofunctional alkoxysilane molecule. Methods and functionalizing agents are described in U.S. Pat. No. 5,474,796, which is herein incorporated by reference in its entirety.

In some instances, a substrate surface is functionalized by contact with a derivatizing composition that contains a mixture of silanes, under reaction conditions effective to couple the silanes to the substrate surface, typically via reactive hydrophilic moieties present on the substrate surface. Silanization generally covers a surface through self-assembly with organofunctional alkoxysilane molecules. A variety of siloxane functionalizing reagents can further be used as currently known in the art, e.g., for lowering or increasing surface energy. The organofunctional alkoxysilanes are classified according to their organic functions.

Polynucleotide Synthesis

Methods of the current disclosure for polynucleotide synthesis may include processes involving phosphoramidite chemistry. In some instances, polynucleotide synthesis comprises coupling a base with phosphoramidite. Polynucleotide synthesis may comprise coupling a base by deposition of phosphoramidite under coupling conditions, wherein the same base is optionally deposited with phosphoramidite more than once, i.e., double coupling. Polynucleotide synthesis may comprise capping of unreacted sites. In some instances, capping is optional. Polynucleotide synthesis may also comprise oxidation or an oxidation step or oxidation steps. Polynucleotide synthesis may comprise deblocking, detritylation, and sulfurization. In some instances, polynucleotide synthesis comprises either oxidation or sulfurization. In some instances, between one or each step during a polynucleotide synthesis reaction, the device is washed, for example, using tetrazole or acetonitrile. Time frames for any one step in a phosphoramidite synthesis method may be less than about 2 min, 1 min, 50 sec, 40 sec, 30 sec, 20 sec and 10 sec.

Polynucleotide synthesis using a phosphoramidite method may comprise a subsequent addition of a phosphoramidite building block (e.g., nucleoside phosphoramidite) to a growing polynucleotide chain for the formation of a phosphite triester linkage. Phosphoramidite polynucleotide synthesis proceeds in 3' to 5' direction. Phosphoramidite polynucleotide synthesis allows for the controlled addition of one nucleotide to a growing nucleic acid chain per synthesis cycle. In some instances, each synthesis cycle comprises a coupling step. Phosphoramidite coupling involves the formation of a phosphite triester linkage between an activated nucleoside phosphoramidite and a nucleoside bound to the substrate, for example, via a linker. In some instances, the nucleoside phosphoramidite is provided to the device activated. In some instances, the nucleoside phosphoramidite is provided to the device with an activator. In some instances, nucleoside phosphoramidites are provided to the device in a 1.5, 2, 3, 4, 5, 6, 7, 8, 9, 10, 11, 12, 13, 14, 15, 16, 17, 18, 19, 20, 25, 30, 35, 40, 50, 60, 70, 80, 90, 100-fold excess or more over the substrate-bound nucleosides. In some instances, the addition of nucleoside phosphoramidite is performed in an anhydrous environment, for example, in anhydrous acetonitrile. Following addition of a nucleoside phosphoramidite, the device is optionally washed. In some instances, the coupling step is repeated one or more additional times, optionally with a wash step between nucleoside phosphoramidite additions to the substrate. In some instances, a polynucleotide synthesis method used herein comprises 1, 2, 3 or more sequential coupling steps. Prior to coupling, in many cases, the nucleoside bound to the device is de-protected by removal of a protecting group, where the protecting group functions to prevent polymerization. A common protecting group is 4,4'-dimethoxytrityl (DMT).

Following coupling, phosphoramidite polynucleotide synthesis methods optionally comprise a capping step. In a capping step, the growing polynucleotide is treated with a capping agent. A capping step is useful to block unreacted substrate-bound 5'—OH groups after coupling from further chain elongation, preventing the formation of polynucleotides with internal base deletions. Further, phosphoramidites activated with 1H-tetrazole may react, to a small extent, with the O6 position of guanosine. Without being bound by theory, upon oxidation with $I_2$/water, this side product, possibly via O6-N7 migration, may undergo depurination. The apurinic sites may end up being cleaved in the course of the final deprotection of the polynucleotide thus reducing the yield of the full-length product. The O6 modifications may be removed by treatment with the capping reagent prior to oxidation with $I_2$/water. In some instances, inclusion of a capping step during polynucleotide synthesis decreases the error rate as compared to synthesis without capping. As an example, the capping step comprises treating the substrate-bound polynucleotide with a mixture of acetic anhydride and 1-methylimidazole. Following a capping step, the device is optionally washed.

In some instances, following addition of a nucleoside phosphoramidite, and optionally after capping and one or more wash steps, the device bound growing nucleic acid is oxidized. The oxidation step comprises a phosphite triester which is oxidized into a tetracoordinated phosphate triester, a protected precursor of the naturally occurring phosphate diester internucleoside linkage. In some instances, oxidation of the growing polynucleotide is achieved by treatment with iodine and water, optionally in the presence of a weak base (e.g., pyridine, lutidine, collidine). Oxidation may be carried out under anhydrous conditions using, e.g. tert-Butyl hydroperoxide or (1S)-(+)-(10-camphorsulfonyl)-oxaziridine (CSO). In some methods, a capping step is performed following oxidation. A second capping step allows for device drying, as residual water from oxidation that may persist can inhibit subsequent coupling. Following oxidation, the device and growing polynucleotide are optionally washed. In some instances, the step of oxidation is substituted with a sulfurization step to obtain polynucleotide phosphorothioates, wherein any capping steps can be performed after the sulfurization. Many reagents are capable of the efficient sulfur transfer, including but not limited to 3-(Dimethylaminomethylidene)amino)-3H-1,2,4-dithiazole-3-thione, DDTT, 3H-1,2-benzodithiol-3-one 1,1-dioxide, also known as Beaucage reagent, and N,N,N'N'-Tetraethylthiuram disulfide (TETD).

In order for a subsequent cycle of nucleoside incorporation to occur through coupling, the protected 5' end of the device bound growing polynucleotide is removed so that the primary hydroxyl group is reactive with a next nucleoside phosphoramidite. In some instances, the protecting group is DMT and deblocking occurs with trichloroacetic acid in dichloromethane. Conducting detritylation for an extended time or with stronger than recommended solutions of acids may lead to increased depurination of solid support-bound polynucleotide and thus reduces the yield of the desired full-length product. Methods and compositions of the disclosure described herein provide for controlled deblocking conditions limiting undesired depurination reactions. In some instances, the device bound polynucleotide is washed after deblocking. In some instances, efficient washing after deblocking contributes to synthesized polynucleotides having a low error rate.

Methods for the synthesis of polynucleotides typically involve an iterating sequence of the following steps: application of a protected monomer to an actively functionalized surface (e.g., locus) to link with either the activated surface, a linker or with a previously deprotected monomer; deprotection of the applied monomer so that it is reactive with a subsequently applied protected monomer; and application of another protected monomer for linking. One or more intermediate steps include oxidation or sulfurization. In some instances, one or more wash steps precede or follow one or all of the steps.

Methods for phosphoramidite-based polynucleotide synthesis comprise a series of chemical steps. In some instances, one or more steps of a synthesis method involve reagent cycling, where one or more steps of the method comprise application to the device of a reagent useful for the step. For example, reagents are cycled by a series of liquid deposition and vacuum drying steps. For substrates comprising three-dimensional features such as wells, microwells, channels and the like, reagents are optionally passed through one or more regions of the device via the wells and/or channels.

Methods and systems described herein relate to polynucleotide synthesis devices for the synthesis of polynucleotides. The synthesis may be in parallel. For example, at least or about at least 2, 3, 4, 5, 6, 7, 8, 9, 10, 11, 12, 13, 14, 15, 16, 17, 18, 19, 20, 21, 22, 23, 24, 25, 30, 35, 40, 45, 50, 100, 150, 200, 250, 300, 350, 400, 450, 500, 550, 600, 650, 700, 750, 800, 850, 900, 1000, 10000, 50000, 75000, 100000 or more polynucleotides can be synthesized in parallel. The total number polynucleotides that may be synthesized in parallel may be from 2-100000, 3-50000, 4-10000, 5-1000, 6-900, 7-850, 8-800, 9-750, 10-700, 11-650, 12-600, 13-550, 14-500, 15-450, 16-400, 17-350, 18-300, 19-250, 20-200, 21-150, 22-100, 23-50, 24-45, 25-40, 30-35. Those of skill in the art appreciate that the total number of polynucleotides synthesized in parallel may fall within any range bound by any of these values, for example 25-100. The total number of polynucleotides synthesized in parallel may fall within any range defined by any of the values serving as endpoints of the range. Total molar mass of polynucleotides synthesized within the device or the molar mass of each of the polynucleotides may be at least or at least about 10, 20, 30, 40, 50, 100, 250, 500, 750, 1000, 2000, 3000, 4000, 5000, 6000, 7000, 8000, 9000, 10000, 25000, 50000, 75000, 100000 picomoles, or more. The length of each of the polynucleotides or average length of the polynucleotides within the device may be at least or about at least 10, 15, 20, 25, 30, 35, 40, 45, 50, 100, 150, 200, 300, 400, 500 nucleotides, or more. The length of each of the polynucleotides or average length of the polynucleotides within the device may be at most or about at most 500, 400, 300, 200, 150, 100, 50, 45, 35, 30, 25, 20, 19, 18, 17, 16, 15, 14, 13, 12, 11, 10 nucleotides, or less. The length of each of the polynucleotides or average length of the polynucleotides within the device may fall from 10-500, 9-400, 11-300, 12-200, 13-150, 14-100, 15-50, 16-45, 17-40, 18-35, 19-25. Those of skill in the art appreciate that the length of each of the polynucleotides or average length of the polynucleotides within the device may fall within any range bound by any of these values, for example 100-300. The length of each of the polynucleotides or average length of the polynucleotides within the device may fall within any range defined by any of the values serving as endpoints of the range.)

Methods for polynucleotide synthesis on a surface provided herein allow for synthesis at a fast rate. As an example, at least 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 70, 80, 90, 100, 125, 150, 175, 200 nucleotides per hour, or more are synthesized. Nucleotides include adenine, guanine, thymine, cytosine, uridine building blocks, or analogs/modified versions thereof. In some instances, libraries of polynucleotides are synthesized in parallel on substrate. For example, a device comprising about or at least about 100; 1,000; 10,000; 30,000; 75,000; 100,000; 1,000,000; 2,000,000; 3,000,000; 4,000,000; or 5,000,000 resolved loci is able to support the synthesis of at least the same number of distinct polynucleotides, wherein polynucleotide encoding a distinct sequence is synthesized on a resolved locus. In some instances, a library of polynucleotides is synthesized on a device with low error rates described herein in less than about three months, two months, one month, three weeks, 15, 14, 13, 12, 11, 10, 9, 8, 7, 6, 5, 4, 3, 2 days, 24 hours, or less. In some instances, larger nucleic acids assembled from a polynucleotide library synthesized with low error rate using the substrates and methods described herein are prepared in less than about three months, two months, one month, three weeks, 15, 14, 13, 12, 11, 10, 9, 8, 7, 6, 5, 4, 3, 2 days, 24 hours, or less.

In some instances, methods described herein provide for generation of a library of nucleic acids comprising variant nucleic acids differing at a plurality of codon sites. In some instances, a nucleic acid may have 1 site, 2 sites, 3 sites, 4 sites, 5 sites, 6 sites, 7 sites, 8 sites, 9 sites, 10 sites, 11 sites, 12 sites, 13 sites, 14 sites, 15 sites, 16 sites, 17 sites 18 sites, 19 sites, 20 sites, 30 sites, 40 sites, 50 sites, or more of variant codon sites.

In some instances, the one or more sites of variant codon sites may be adjacent. In some instances, the one or more sites of variant codon sites may not be adjacent but are separated by 1, 2, 3, 4, 5, 6, 7, 8, 9, 10, or more codons.

In some instances, a nucleic acid may comprise multiple sites of variant codon sites, wherein all the variant codon sites are adjacent to one another, forming a stretch of variant codon sites. In some instances, a nucleic acid may comprise multiple sites of variant codon sites, wherein none the variant codon sites are adjacent to one another. In some instances, a nucleic acid may comprise multiple sites of variant codon sites, wherein some the variant codon sites are adjacent to one another, forming a stretch of variant codon sites, and some of the variant codon sites are not adjacent to one another.

Figure 3:
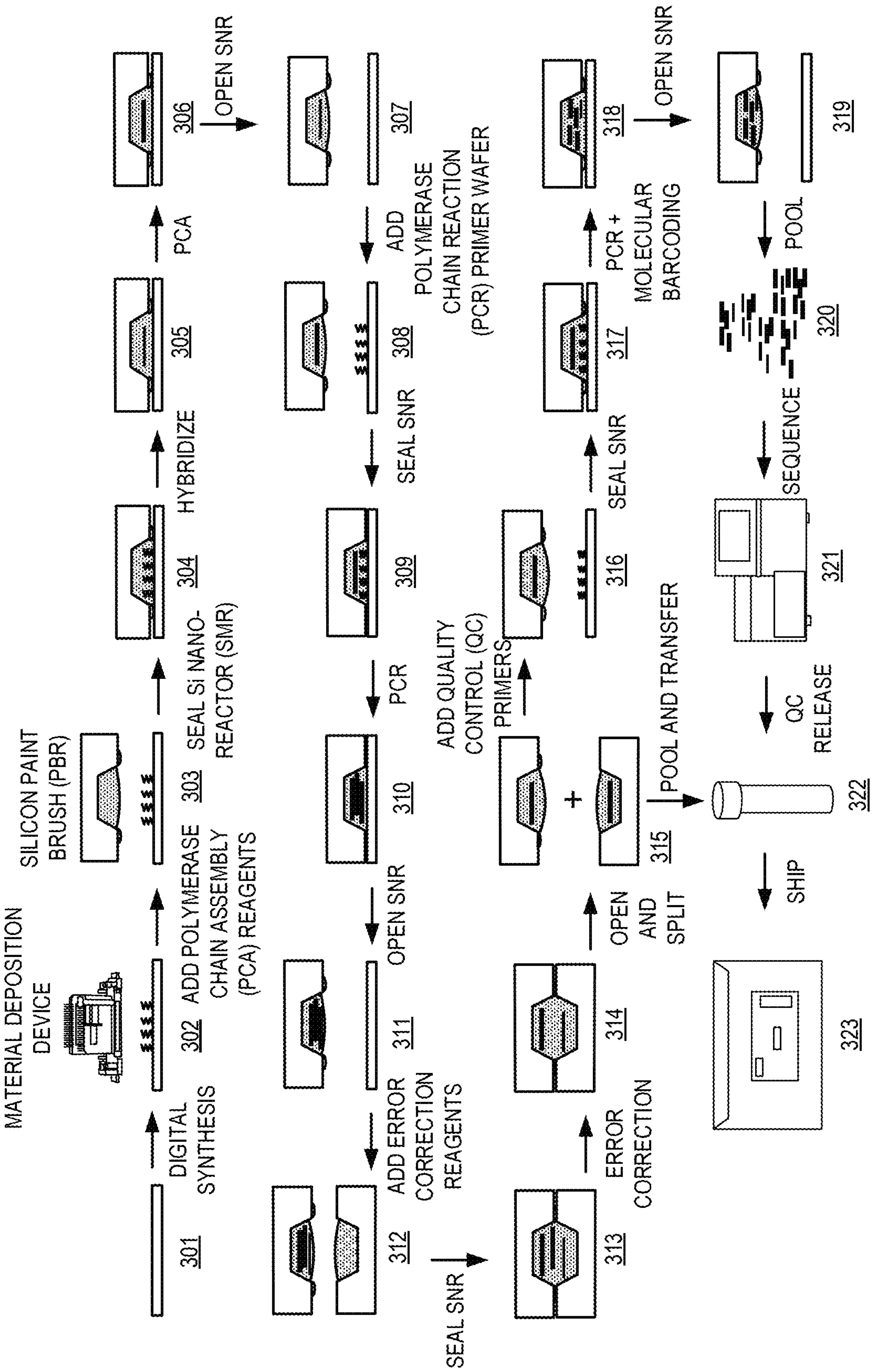
FIG. 3 presents a diagram of steps demonstrating an exemplary process workflow for gene synthesis as disclosed herein.

Referring to the Figures, FIG. 3 illustrates an exemplary process workflow for synthesis of nucleic acids (e.g., genes) from shorter nucleic acids. The workflow is divided generally into phases: (1) de novo synthesis of a single stranded nucleic acid library, (2) joining nucleic acids to form larger fragments, (3) error correction, (4) quality control, and (5) shipment. Prior to de novo synthesis, an intended nucleic acid sequence or group of nucleic acid sequences is preselected. For example, a group of genes is preselected for generation.

Once large nucleic acids for generation are selected, a predetermined library of nucleic acids is designed for de novo synthesis. Various suitable methods are known for generating high density polynucleotide arrays. In the workflow example, a device surface layer 301 is provided. In the example, chemistry of the surface is altered in order to improve the polynucleotide synthesis process. Areas of low surface energy are generated to repel liquid while areas of high surface energy are generated to attract liquids. The surface itself may be in the form of a planar surface or contain variations in shape, such as protrusions or microwells which increase surface area. In the workflow example, high surface energy molecules selected serve a dual function of supporting DNA chemistry, as disclosed in International Patent Application Publication WO/2015/021080, which is herein incorporated by reference in its entirety.

In situ preparation of polynucleotide arrays is generated on a solid support 301 and utilizes single nucleotide extension process to extend multiple oligomers in parallel. A deposition device, such as a material deposition device, is designed to release reagents in a step-wise fashion such that multiple polynucleotides extend, in parallel, one residue at a time to generate oligomers with a predetermined nucleic acid sequence 302. In some instances, polynucleotides are cleaved from the surface at this stage. Cleavage includes gas cleavage, e.g., with ammonia or methylamine.

The generated polynucleotide libraries are placed in a reaction chamber. In this exemplary workflow, the reaction chamber (also referred to as "nanoreactor") is a silicon coated well, containing PCR reagents and lowered onto the polynucleotide library 303. Prior to or after the sealing 304 of the polynucleotides, a reagent is added to release the polynucleotides from the substrate. In the exemplary workflow, the polynucleotides are released subsequent to sealing of the nanoreactor 305. Once released, fragments of single stranded polynucleotides hybridize in order to span an entire long-range sequence of DNA. Partial hybridization 305 is possible because each synthesized polynucleotide is designed to have a small portion overlapping with at least one other polynucleotide in the pool.

After hybridization, a PCA reaction is commenced. During the polymerase cycles, the polynucleotides anneal to complementary fragments and gaps are filled in by a polymerase. Each cycle increases the length of various fragments randomly depending on which polynucleotides find each other. Complementarity amongst the fragments allows for formation of a complete large span of double stranded DNA 306.

After PCA is complete, the nanoreactor is separated from the device 307 and positioned for interaction with a device having primers for PCR 308. After sealing, the nanoreactor is subject to PCR 309 and the larger nucleic acids are amplified. After PCR 310, the nanochamber is opened 311, error correction reagents are added 312, the chamber is sealed 313 and an error correction reaction occurs to remove mismatched base pairs and/or strands with poor complementarity from the double stranded PCR amplification products 314. The nanoreactor is opened and separated 315. Error corrected product is next subject to additional processing steps, such as PCR and molecular bar coding, and then packaged 322 for shipment 323.

In some instances, quality control measures are taken. After error correction, quality control steps include for example interaction with a wafer having sequencing primers for amplification of the error corrected product 316, sealing the wafer to a chamber containing error corrected amplification product 317, and performing an additional round of amplification 318. The nanoreactor is opened 319 and the products are pooled 320 and sequenced 321. After an acceptable quality control determination is made, the packaged product 322 is approved for shipment 323.

In some instances, a nucleic acid generated by a workflow such as that in FIG. 3 is subject to mutagenesis using overlapping primers disclosed herein. In some instances, a library of primers is generated by in situ preparation on a solid support and utilize single nucleotide extension process to extend multiple oligomers in parallel. A deposition device, such as a material deposition device, is designed to release reagents in a step wise fashion such that multiple polynucleotides extend, in parallel, one residue at a time to generate oligomers with a predetermined nucleic acid sequence 302.

Computer Systems

Any of the systems described herein, may be operably linked to a computer and may be automated through a computer either locally or remotely. In various instances, the methods and systems of the disclosure may further comprise software programs on computer systems and use thereof. Accordingly, computerized control for the synchronization of the dispense/vacuum/refill functions such as orchestrating and synchronizing the material deposition device movement, dispense action and vacuum actuation are within the bounds of the disclosure. The computer systems may be programmed to interface between the user specified base sequence and the position of a material deposition device to deliver the correct reagents to specified regions of the substrate.

Figure 4:
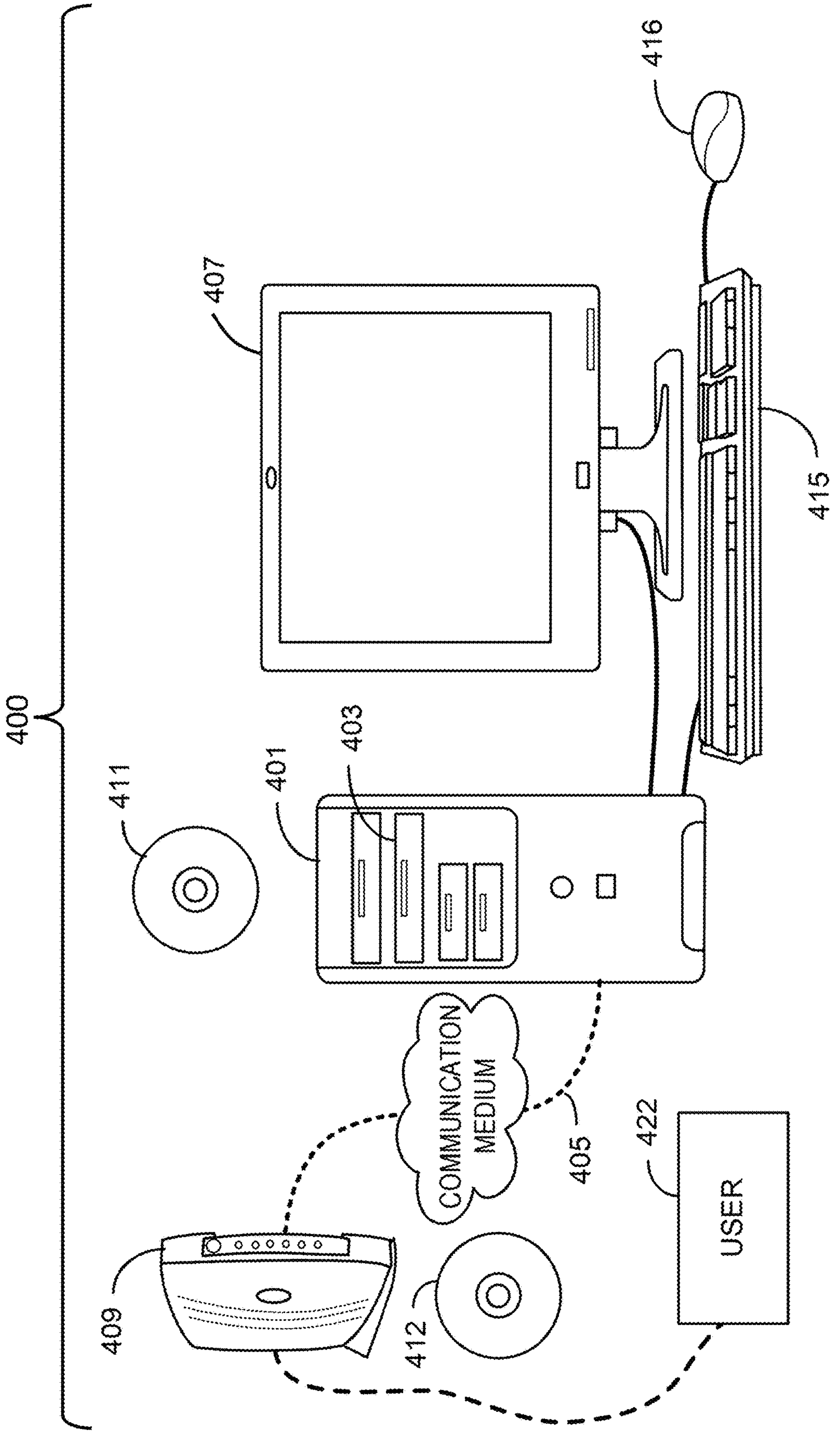
FIG. 4 illustrates an example of a computer system.

The computer system 400 illustrated in FIG. 4 may be understood as a logical apparatus that can read instructions from media 411 and/or a network port 405, which can optionally be connected to server 409 having fixed media 412. The system, such as shown in FIG. 4 can include a CPU 401, disk drives 403, optional input devices such as keyboard 415 and/or mouse 416 and optional monitor 407. Data communication can be achieved through the indicated communication medium to a server at a local or a remote location. The communication medium can include any means of transmitting and/or receiving data. For example, the communication medium can be a network connection, a wireless connection or an internet connection. Such a connection can provide for communication over the World Wide Web. It is envisioned that data relating to the present disclosure can be transmitted over such networks or connections for reception and/or review by a party 422 as illustrated in FIG. 4.

Figure 5:
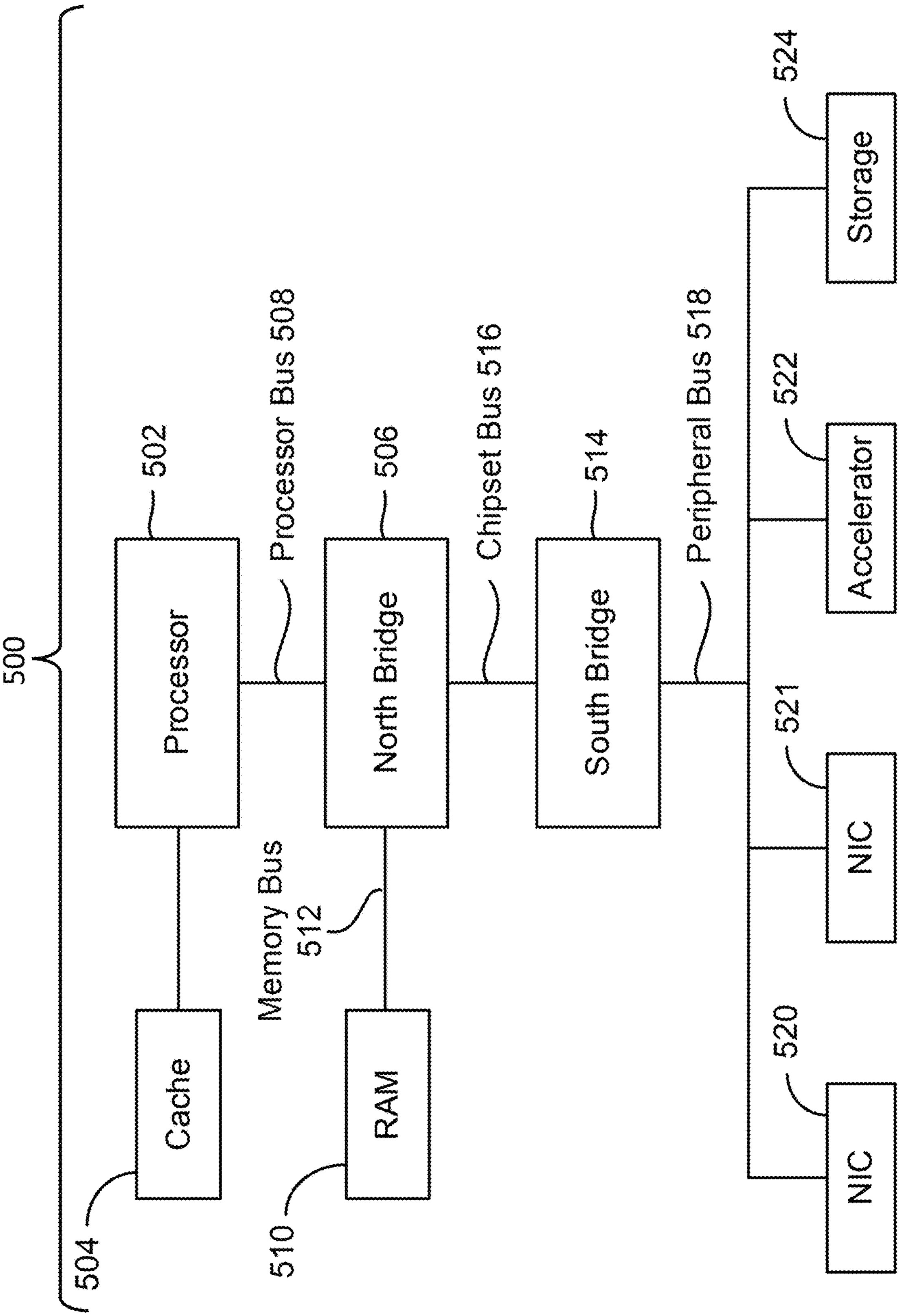
FIG. 5 is a block diagram illustrating an architecture of a computer system.

FIG. 5 is a block diagram illustrating a first example architecture of a computer system 500 that can be used in connection with example instances of the present disclosure. As depicted in FIG. 5, the example computer system can include a processor 502 for processing instructions. Non-limiting examples of processors include: Intel Xeon™ processor, AMD Opteron™ processor, Samsung 32-bit RISC ARM 1176JZ (F)-S v1.0™ processor, ARM Cortex-A8 Samsung S5PC100™ processor, ARM Cortex-A8 Apple A4™ processor, Marvell PXA 93014 processor, or a functionally-equivalent processor. Multiple threads of execution can be used for parallel processing. In some instances, multiple processors or processors with multiple cores can also be used, whether in a single computer system, in a cluster, or distributed across systems over a network comprising a plurality of computers, cell phones, and/or personal data assistant devices.

As illustrated in FIG. 5, a high-speed cache 504 can be connected to, or incorporated in, the processor 502 to provide a high speed memory for instructions or data that have been recently, or are frequently, used by the processor 502. The processor 502 is connected to a north bridge 506 by a processor bus 508. The north bridge 506 is connected to random access memory (RAM) 510 by a memory bus 512 and manages access to the RAM 510 by the processor 502. The north bridge 506 is also connected to a south bridge 514 by a chipset bus 516. The south bridge 514 is, in turn, connected to a peripheral bus 518. The peripheral bus can be, for example, PCI, PCI-X, PCI Express, or other peripheral bus. The north bridge and south bridge are often referred to as a processor chipset and manage data transfer between the processor, RAM, and peripheral components on the peripheral bus 518. In some alternative architectures, the functionality of the north bridge can be incorporated into the processor instead of using a separate north bridge chip. In some instances, system 500 can include an accelerator card 522 attached to the peripheral bus 518. The accelerator can include field programmable gate arrays (FPGAs) or other hardware for accelerating certain processing. For example, an accelerator can be used for adaptive data restructuring or to evaluate algebraic expressions used in extended set processing.

Software and data are stored in external storage 524 and can be loaded into RAM 510 and/or cache 504 for use by the processor. The system 500 includes an operating system for managing system resources; non-limiting examples of operating systems include: Linux®, Windows®, MACOS®, BlackBerry® OS™, BlackBerry® iOS®, and other functionally-equivalent operating systems, as well as application software running on top of the operating system for managing data storage and optimization in accordance with example instances of the present disclosure. In this example, system 500 also includes network interface cards (NICs) 520 and 521 connected to the peripheral bus for providing network interfaces to external storage, such as Network Attached Storage (NAS) and other computer systems that can be used for distributed parallel processing.

Figure 6:
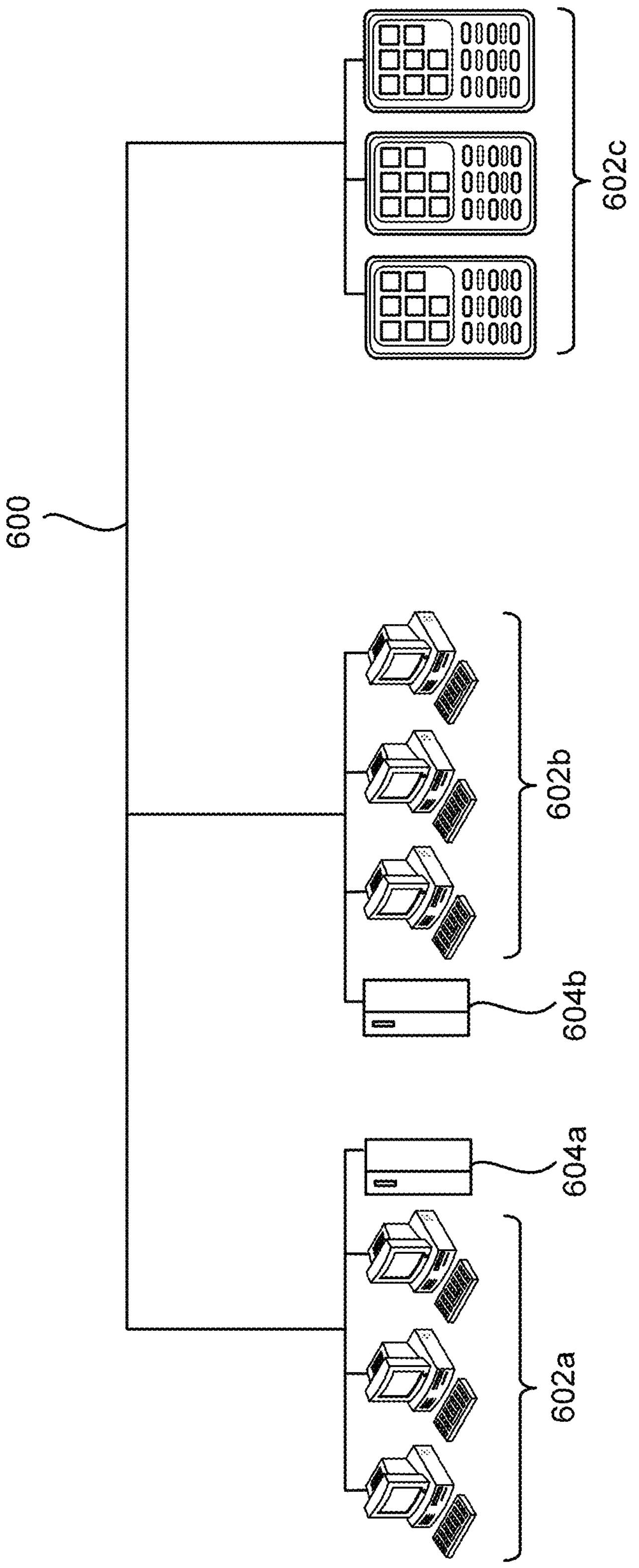
FIG. 6 is a diagram demonstrating a network configured to incorporate a plurality of computer systems, a plurality of cell phones and personal data assistants, and Network Attached Storage (NAS).

FIG. 6 is a diagram showing a network 600 with a plurality of computer systems 602*a*, and 602*b*, a plurality of cell phones and personal data assistants 602*c*, and Network Attached Storage (NAS) 604*a*, and 604*b*. In example instances, systems 602*a*, 602*b*, and 602*c* can manage data storage and optimize data access for data stored in Network Attached Storage (NAS) 604*a* and 604*b*. A mathematical model can be used for the data and be evaluated using distributed parallel processing across computer systems 602*a*, and 602*b*, and cell phone and personal data assistant systems 602*c*. Computer systems 602*a*, and 602*b*, and cell phone and personal data assistant systems 602*c* can also provide parallel processing for adaptive data restructuring of the data stored in Network Attached Storage (NAS) 604*a* and 604*b*. FIG. 6 illustrates an example only, and a wide variety of other computer architectures and systems can be used in conjunction with the various instances of the present disclosure. For example, a blade server can be used to provide parallel processing. Processor blades can be connected through a back plane to provide parallel processing. Storage can also be connected to the back plane or as Network Attached Storage (NAS) through a separate network interface. In some example instances, processors can maintain separate memory spaces and transmit data through network interfaces, back plane or other connectors for parallel processing by other processors. In other instances, some or all of the processors can use a shared virtual address memory space.

Figure 7:
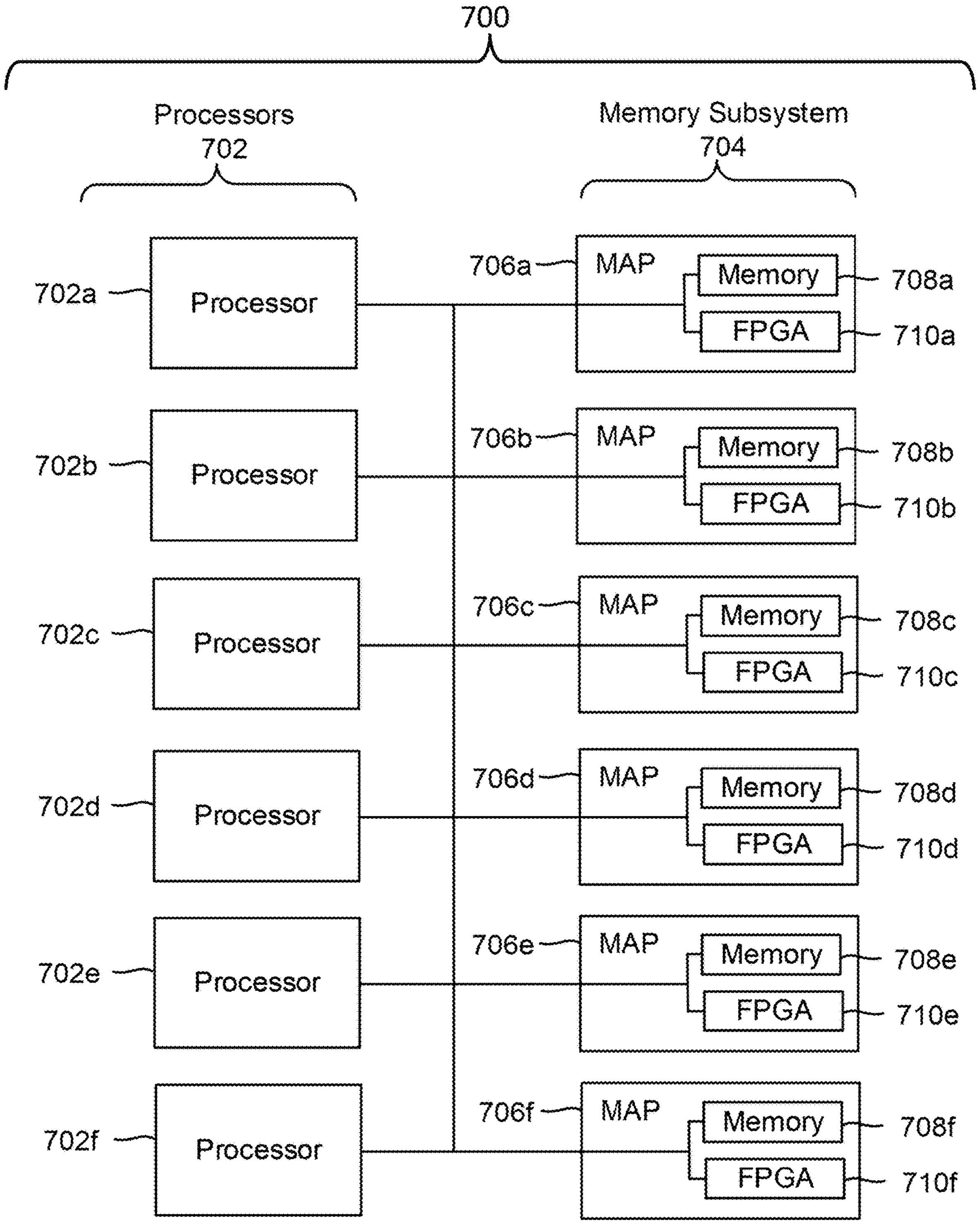
FIG. 7 is a block diagram of a multiprocessor computer system using a shared virtual address memory space.
Figure 8A:
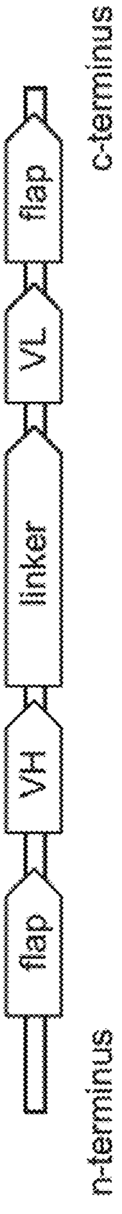
FIG. 8A depicts a schematic of an immunoglobulin comprising a VH domain attached to a VL domain using a linker.
Figure 8B:
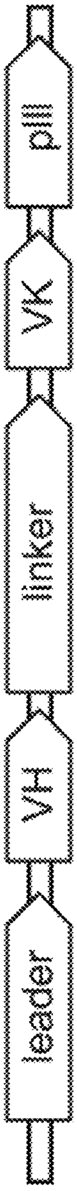
FIG. 8B depicts a schematic of a full-domain architecture of an immunoglobulin comprising a VH domain attached to a VL domain using a linker, a leader sequence, and pIII sequence.
Figure 8C:
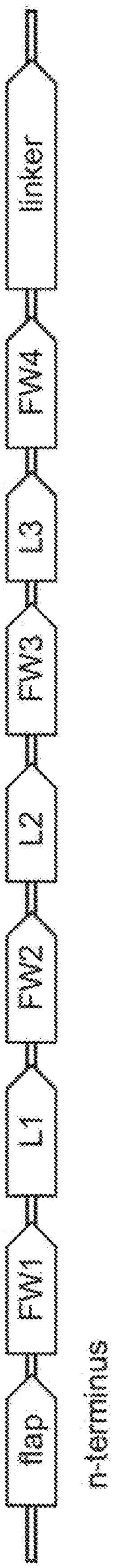
FIG. 8C depicts a schematic of four framework elements (FW1, FW2, FW3, FW4) and the variable 3 CDR (L1, L2, L3) elements for a VL or VH domain.
Figure 9A:
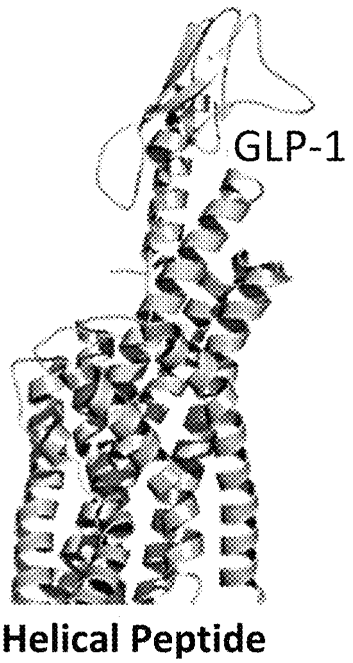
FIG. 9A depicts a structure of Glucagon-like peptide 1 (GLP-1) in complex with GLP-1 receptor (GLP-1R), PDB entry 5VAI.
Figure 9B:
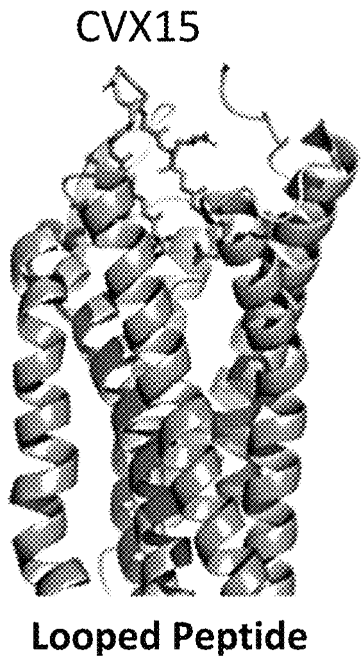
FIG. 9B depicts a crystal structure of CXCR4 chemokine receptor in complex with a cyclic peptide antagonist CVX15, PDB entry 3OR0.
Figure 9C:
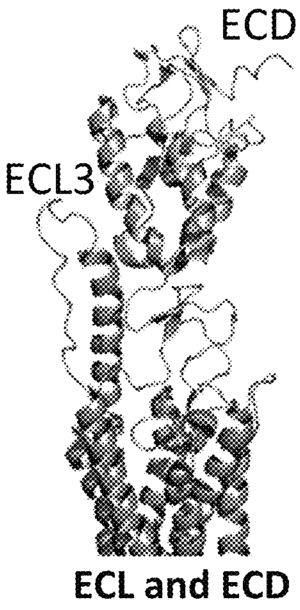
FIG. 9C depicts a crystal structure of human smoothened receptor with the transmembrane domain and extracellular domain (ECD), PDB entry 5L7D. The ECD contacts the TMD through extracellular loop 3 (ECL3).
Figure 9D:
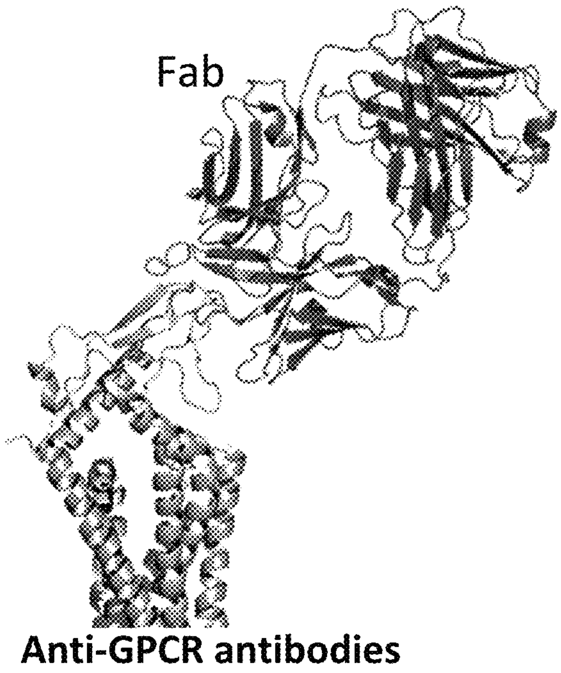
FIG. 9D depicts a structure of GLP-1R in complex with a Fab, PDB entry 6LN2.
Figure 9E:
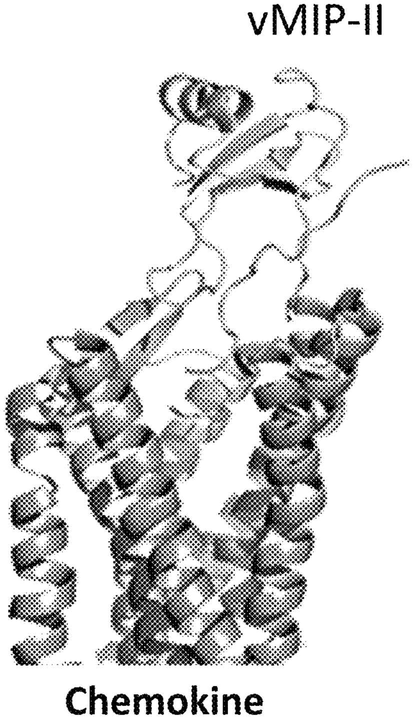
FIG. 9E depicts a crystal structure of CXCR4 in complex with a viral chemokine antagonist Viral macrophage inflammatory protein 2 (vMIP-II), PDB entry 4RWS.

FIG. 7 is a block diagram of a multiprocessor computer system 700 using a shared virtual address memory space in accordance with an example instance. The system includes a plurality of processors 702 that can access a shared memory subsystem 704. The system incorporates a plurality of programmable hardware memory algorithm processors (MAPs) 706*a-f* in the memory subsystem 704. Each MAP 706*a-f* can comprise a memory 708*a-f* and one or more field programmable gate arrays (FPGAs) 710*a-f*. The MAP provides a configurable functional unit and particular algorithms or portions of algorithms can be provided to the FPGAs 710*a-f* for processing in close coordination with a respective processor. For example, the MAPs can be used to evaluate algebraic expressions regarding the data model and to perform adaptive data restructuring in example instances. In this example, each MAP is globally accessible by all of the processors for these purposes. In one configuration, each MAP can use Direct Memory Access (DMA) to access an associated memory 708*a-f*, allowing it to execute tasks independently of, and asynchronously from the respective microprocessor 702*a-f*. In this configuration, a MAP can feed results directly to another MAP for pipelining and parallel execution of algorithms.

The above computer architectures and systems are examples only, and a wide variety of other computer, cell phone, and personal data assistant architectures and systems can be used in connection with example instances, including systems using any combination of general processors, co-processors, FPGAs and other programmable logic devices, system on chips (SOCs), application specific integrated circuits (ASICs), and other processing and logic elements. In some instances, all or part of the computer system can be implemented in software or hardware. Any variety of data storage media can be used in connection with example instances, including random access memory, hard drives, flash memory, tape drives, disk arrays, Network Attached Storage (NAS) and other local or distributed data storage devices and systems.

In example instances, the computer system can be implemented using software modules executing on any of the above or other computer architectures and systems. In other instances, the functions of the system can be implemented partially or completely in firmware, programmable logic devices such as field programmable gate arrays (FPGAs) as referenced in FIG. 5, system on chips (SOCs), application specific integrated circuits (ASICs), or other processing and logic elements. For example, the Set Processor and Optimizer can be implemented with hardware acceleration through the use of a hardware accelerator card, such as accelerator card 522 illustrated in FIG. 5.

The following examples are set forth to illustrate more clearly the principle and practice of embodiments disclosed herein to those skilled in the art and are not to be construed as limiting the scope of any claimed embodiments. Unless otherwise stated, all parts and percentages are on a weight basis.

EXAMPLES

The following examples are given for the purpose of illustrating various embodiments of the disclosure and are not meant to limit the present disclosure in any fashion. The present examples, along with the methods described herein are presently representative of preferred embodiments, are exemplary, and are not intended as limitations on the scope of the disclosure. Changes therein and other uses which are encompassed within the spirit of the disclosure as defined by the scope of the claims will occur to those skilled in the art.

Example 1: Functionalization of a Device Surface

A device was functionalized to support the attachment and synthesis of a library of polynucleotides. The device surface was first wet cleaned using a piranha solution comprising 90% $H_2SO_4$ and 10% $H_2O_2$ for 20 minutes. The device was rinsed in several beakers with DI water, held under a DI water gooseneck faucet for 5 min, and dried with $N_2$. The device was subsequently soaked in $NH_4OH$ (1:100; 3 mL: 300 mL) for 5 min, rinsed with DI water using a handgun, soaked in three successive beakers with DI water for 1 min each, and then rinsed again with DI water using the handgun. The device was then plasma cleaned by exposing the device surface to $O_2$. A SAMCO PC-300 instrument was used to plasma etch $O_2$ at 250 watts for 1 min in downstream mode.

The cleaned device surface was actively functionalized with a solution comprising N-(3-triethoxysilylpropyl)-4-hydroxybutyramide using a YES-1224P vapor deposition oven system with the following parameters: 0.5 to 1 torr, 60 min, 70° C., 135° C. vaporizer. The device surface was resist coated using a Brewer Science 200X spin coater. SPR™ 3612 photoresist was spin coated on the device at 2500 rpm for 40 sec. The device was pre-baked for 30 min at 90° C. on a Brewer hot plate. The device was subjected to photolithography using a Karl Suss MA6 mask aligner instrument. The device was exposed for 2.2 sec and developed for 1 min in MSF 26A. Remaining developer was rinsed with the handgun and the device soaked in water for 5 min. The device was baked for 30 min at 100° C. in the oven, followed by visual inspection for lithography defects using a Nikon L200. A descum process was used to remove residual resist using the SAMCO PC-300 instrument to $O_2$ plasma etch at 250 watts for 1 min.

The device surface was passively functionalized with a 100 μL solution of perfluorooctyltrichlorosilane mixed with 10 μL light mineral oil. The device was placed in a chamber, pumped for 10 min, and then the valve was closed to the pump and left to stand for 10 min. The chamber was vented to air. The device was resist stripped by performing two soaks for 5 min in 500 mL NMP at 70° C. with ultrasonication at maximum power (9 on Crest system). The device was then soaked for 5 min in 500 mL isopropanol at room temperature with ultrasonication at maximum power. The device was dipped in 300 mL of 200 proof ethanol and blown dry with $N_2$. The functionalized surface was activated to serve as a support for polynucleotide synthesis.

Example 2: Synthesis of a 50-mer Sequence on an Oligonucleotide Synthesis Device A two-dimensional oligonucleotide synthesis device was assembled into a flowcell, which was connected to a flowcell (Applied Biosystems® "ABI394 DNA Synthesizer"). The two-dimensional oligonucleotide synthesis device was uniformly functionalized with N-(3-TRIETHOXYSILYLPROPYL)-4-HYDROXYBUTYRAMIDE (Gelest) which was used to synthesize an exemplary polynucleotide of 50 bp ("50-mer polynucleotide") using polynucleotide synthesis methods described herein.

The sequence of the 50-mer was as described in SEQ ID NO: 1348. 5'AGACAATCAACCATTTGGGGTGGACAGCCTTGACCTCTAGACTTCGGCAT ##TTTTTTT TTT3' (SEQ ID NO.: 1348), where #denotes Thymidine-succinyl hexamide CED phosphoramidite (CLP-2244 from ChemGenes), which is a cleavable linker enabling the release of oligos from the surface during deprotection.

The synthesis was done using standard DNA synthesis chemistry (coupling, capping, oxidation, and deblocking) according to the protocol in Table 3 and an ABI synthesizer.

TABLE 3

| Synthesis protocols | | |
|---|---|---|
| | Table 3 | |
| General DNA Synthesis Process Name | Process Step | Time (sec) |
| WASH (Acetonitrile Wash Flow) | Acetonitrile System Flush | 4 |
| | Acetonitrile to Flowcell | 23 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 6 |
| | Activator + Phosphoramidite to Flowcell | 6 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Activator to Flowcell | 0.5 |
| | Activator + Phosphoramidite to Flowcell | 5 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| DNA BASE ADDITION (Phosphoramidite + Activator Flow) | Activator Manifold Flush | 2 |
| | Activator to Flowcell | 5 |
| | Activator + Phosphoramidite to Flowcell | 18 |
| | Incubate for 25 sec | 25 |
| WASH (Acetonitrile Wash Flow) | Acetonitrile System Flush | 4 |
| | Acetonitrile to Flowcell | 15 |
| | N2 System Flush | 4 |
| | Acetonitrile System Flush | 4 |
| CAPPING (CapA + B, 1:1, Flow) | CapA + B to Flowcell | 15 |
| WASH (Acetonitrile Wash Flow) | Acetonitrile System Flush | 4 |
| | Acetonitrile to Flowcell | 15 |
| | Acetonitrile System Flush | 4 |
| OXIDATION (Oxidizer Flow) | Oxidizer to Flowcell | 18 |
| WASH (Acetonitrile Wash Flow) | Acetonitrile System Flush | 4 |
| | N2 System Flush | 4 |
| | Acetonitrile System Flush | 4 |
| | Acetonitrile to Flowcell | 15 |
| | Acetonitrile System Flush | 4 |
| | Acetonitrile to Flowcell | 15 |
| | N2 System Flush | 4 |
| | Acetonitrile System Flush | 4 |
| | Acetonitrile to Flowcell | 23 |
| | N2 System Flush | 4 |
| | Acetonitrile System Flush | 4 |
| DEBLOCKING (Deblock Flow) | Deblock to Flowcell | 36 |
| WASH (Acetonitrile Wash Flow) | Acetonitrile System Flush | 4 |
| | N2 System Flush | 4 |
| | Acetonitrile System Flush | 4 |
| | Acetonitrile to Flowcell | 18 |
| | N2 System Flush | 4.13 |
| | Acetonitrile System Flush | 4.13 |
| | Acetonitrile to Flowcell | 15 |

The phosphoramidite/activator combination was delivered similarly to the delivery of bulk reagents through the flowcell. No drying steps were performed as the environment stays "wet" with reagent the entire time.

The flow restrictor was removed from the ABI 394 synthesizer to enable faster flow. Without flow restrictor, flow rates for amidites (0.1M in ACN), Activator, (0.25M Benzoylthiotetrazole ("BTT"; 30-3070-xx from GlenResearch) in ACN), and Ox (0.02M I2 in 20% pyridine, 10% water, and 70% THF) were roughly ~100 uL/sec, for acetonitrile ("ACN") and capping reagents (1:1 mix of CapA and CapB, wherein CapA is acetic anhydride in THF/Pyridine and CapB is 16% 1-methylimidizole in THF), roughly ~200 uL/sec, and for Deblock (3% dichloroacetic acid in toluene), roughly ~300 uL/sec (compared to ~50 uL/sec for all reagents with flow restrictor). The time to completely push out Oxidizer was observed, the timing for chemical flow times was adjusted accordingly and an extra ACN wash was introduced between different chemicals. After polynucleotide synthesis, the chip was deprotected in gaseous ammonia overnight at 75 psi. Five drops of water were applied to the surface to recover polynucleotides. The recovered polynucleotides were then analyzed on a BioAnalyzer small RNA chip.

Example 3: Synthesis of a 100-mer Sequence on an Oligonucleotide Synthesis Device The same process as described in Example 2 for the synthesis of the 50-mer sequence was used for the synthesis of a 100-mer polynucleotide ("100-mer polynucleotide"; 5' CGGGATCCTTATCGTCATCGTCGTACA-GATCCCGACCCATTTGCTGTCCACCAGTCATG CTAGCCATACCATGATGATGATGATGAT-GAGAACCCCGCAT ##TTTTTTTTTT3', where #denotes Thymidine-succinyl hexamide CED phosphoramidite (CLP-2244 from ChemGenes); SEQ ID NO.: 1349) on two different silicon chips, the first one uniformly functionalized with N-(3-TRIETHOXYSILYLPROPYL)-4-HYDROXY-BUTYRAMIDE and the second one functionalized with 5/95 mix of 11-acetoxyundecyltriethoxysilane and n-decyltriethoxysilane, and the polynucleotides extracted from the surface were analyzed on a BioAnalyzer instrument.

All ten samples from the two chips were further PCR amplified using a forward (5'ATGCGGGGTTCTCATCATC3'; SEQ ID NO.: 1350) and a reverse (5'CGGGATCCTTATCGTCATCG3'; SEQ ID NO.: 1351) primer in a 50 uL PCR mix (25 uL NEB Q5 mastermix, 2.5 uL 10 uM Forward primer, 2.5 uL 10 uM Reverse primer, 1 uL polynucleotide extracted from the surface, and water up to 50 uL) using the following thermalcycling program:

98° C., 30 sec

98° C., 10 sec; 63° C., 10 sec; 72° C., 10 sec; repeat 12 cycles

72° C., 2 min

The PCR products were also run on a BioAnalyzer, demonstrating sharp peaks at the 100-mer position. Next, the PCR amplified samples were cloned, and Sanger sequenced. Table 4 summarizes the results from the Sanger sequencing for samples taken from spots 1-5 from chip 1 and for samples taken from spots 6-10 from chip 2.

TABLE 4

| Sequencing results | | |
|---|---|---|
| Spot | Error rate | Cycle efficiency |
| 1 | 1/763 bp | 99.87% |
| 2 | 1/824 bp | 99.88% |
| 3 | 1/780 bp | 99.87% |
| 4 | 1/429 bp | 99.77% |
| 5 | 1/1525 bp | 99.93% |
| 6 | 1/1615 bp | 99.94% |
| 7 | 1/531 bp | 99.81% |

TABLE 4-continued

| Sequencing results | | |
|---|---|---|
| Spot | Error rate | Cycle efficiency |
| 8 | 1/1769 bp | 99.94% |
| 9 | 1/854 bp | 99.88% |
| 10 | 1/1451 bp | 99.93% |

Thus, the high quality and uniformity of the synthesized polynucleotides were repeated on two chips with different surface chemistries. Overall, 89% of the 100-mers that were sequenced were perfect sequences with no errors, corresponding to 233 out of 262.

Table 5 summarizes error characteristics for the sequences obtained from the polynucleotide samples from spots 1-10.

TABLE 5

| Error characteristics | | | | | | | | | | |
|---|---|---|---|---|---|---|---|---|---|---|
| Sample ID/Spot no. | OSA_ 0046/1 | OSA_ 0047/2 | OSA_ 0048/3 | OSA_ 0049/4 | OSA_ 0050/5 | OSA_ 0051/6 | OSA_ 0052/7 | OSA_ 0053/8 | OSA_ 0054/9 | OSA_ 0055/10 |
| Total Sequences | 32 | 32 | 32 | 32 | 32 | 32 | 32 | 32 | 32 | 32 |
| Sequencing Quality | 25 of 28 | 27 of 27 | 26 of 30 | 21 of 23 | 25 of 26 | 29 of 30 | 27 of 31 | 29 o f31 | 28 of 29 | 25 of 28 |
| Oligo Quality | 23 of 25 | 25 of 27 | 22 of 26 | 18 of 21 | 24 of 25 | 25 of 29 | 22 of 27 | 28 of 29 | 26 of 28 | 20 of 25 |
| ROI Match Count | 2500 | 2698 | 2561 | 2122 | 2499 | 2666 | 2625 | 2899 | 2798 | 2348 |
| ROI Mutation | 2 | 2 | 1 | 3 | 1 | 0 | 2 | 1 | 2 | 1 |
| ROI Multi Base Deletion | 0 | 0 | 0 | 0 | 0 | 0 | 0 | 0 | 0 | 0 |
| ROI Small Insertion | 1 | 0 | 0 | 0 | 0 | 0 | 0 | 0 | 0 | 0 |
| ROI Single Base Deletion | 0 | 0 | 0 | 0 | 0 | 0 | 0 | 0 | 0 | 0 |
| Large Deletion Count | 0 | 0 | 1 | 0 | 0 | 1 | 1 | 0 | 0 | 0 |
| Mutation: G > A | 2 | 2 | 1 | 2 | 1 | 0 | 2 | 1 | 2 | 1 |
| Mutation: T > C | 0 | 0 | 0 | 1 | 0 | 0 | 0 | 0 | 0 | 0 |
| ROI Error Count | 3 | 2 | 2 | 3 | 1 | 1 | 3 | 1 | 2 | 1 |
| ROI Error Rate | Err:~1 in 834 | Err:~1 in 1350 | Err:~1 in 1282 | Err:~1 in 708 | Err:~1 in 2500 | Err:~1 in 2667 | Err:~1 in 876 | Err:~1 in 2900 | Err:~1 in 1400 | Err:~1 in 2349 |
| ROI Minus Primer Error Rate | MP Err: ~1 in 763 | MP Err: ~1 in 824 | MP Err: ~1 in 780 | MP Err: ~1 in 429 | MP Err: ~1 in 1525 | MP Err: ~1 in 1615 | MP Err: ~1 in 531 | MP Err: ~1 in 1769 | MP Err: ~1 in 854 | MP Err: ~1 in 1451 |

Example 4: Functional GLP-1R Antibodies Identified from a Synthetic GPCR-Focused Library Demonstrate Potent Blood Glucose Control This example describes the identification of antagonistic and agonistic GLP-1R antibodies with in vitro and in vivo functional activity.

Materials and Method

Stable Cell Line and Phage Library Generation

The full length human GLP-1R gene (UniProt-P43220) with an N-terminal FLAG tag and C-terminal GFP tag cloned into pCDNA3.1 (+) vector (ThermoFisher) was transfected into suspension Chinese Hamster Ovary (CHO) cells to generate the stable cell line expressing GLP-1R. Target expression was confirmed by FACS. Cells expressing >80% of GLP-1R by GFP were then directly used for cell-based selections.

Germline heavy chain IGHV1-69, IGHV3-30 and germline light chain IGKV1-39, IGKV3-15, IGLV1-51, IGL V2-14 framework combinations were used in the GPCR-focused phage-displayed library, and all six CDR diversities were encoded by oligo pools synthesized similar to Examples 1-3 above. The CDRs were also screened to ensure they did not contain manufacturability liabilities, cryptic splice sites, or commonly used nucleotide restriction sites. The heavy chain variable region (VH) and light chain variable region (VL) were linked by (G4S) 3 linker (SEQ ID NO: 1520). The resulting scFv (VH-linker-VL) gene library was cloned into a pADL 22-2c (Antibody Design Labs) phage display vector by NotI restriction digestion and electroporated into TG1 electro-competent *E. coli* cells. (Lucigen). The final library has a diversity of $1.1\times10^{10}$ size, which was verified by NGS.

Panning and Screening Strategy Used to Isolate Agonist GLP-1R scFv Clones

Before panning on GLP-1R expressing CHO cells, phage particles were blocked with 5% BSA/PBS and depleted for non-specific binders on CHO parent cells. For CHO parent cell depletion, the input phage aliquot was rotated at 14 rpm/min with $1\times10^8$ CHO parent cells for 1 hour at room temperature (RT). The cells were then pelleted by centrifuging at 1,200 rpm for 10 mins in a tabletop Eppendorf centrifuge 5920RS/4×1000 rotor to deplete the non-specific CHO cell binders. The phage supernatant, depleted of CHO cell binders, was then transferred to $1\times10^8$ GLP-1R expressing CHO cells. The phage supernatant and GLP-1R expressing CHO cells were rotated at 14 rpm/min for 1 hour at RT to select for GLP-1R binders. After incubation, the cells were washed several times with 1×PBS/0.5% Tween to remove non-binding clones. To elute the phage bound to the GLP-1R cells, the cells were incubated with trypsin in PBS buffer for 30 minutes at 37° C. The cells were pelleted by centrifuging at 1,200 rpm for 10 mins. The output supernatant enriched in GLP-1R binding clones was amplified in TG1 *E. coli* cells to use as input phage for the next round of selection. This selection strategy was repeated for five rounds. Every round was depleted against the CHO parent background. Amplified output phage from a round was used as the input phage for the subsequent round, and the stringency of washes were increased in each subsequent round of selections with more washes. After five rounds of selection, 500 clones from each of round 4 and round 5 were Sanger sequenced to identify unique clones.

Next-Generation Sequencing Analysis

The phagemid DNA was miniprepped from the output bacterial stocks of all panning rounds. The variable heavy chain (VH) was PCR amplified from the phagemid DNA using the Forward Primer ACAGAATTCATTAAAGAGGAGAAATTAACC (SEQ ID NO: 1521) and reverse primer TGAACCGCCTCCACCGCTAG (SEQ ID NO: 1522). The PCR product was directly used for library preparation using the KAPA HyperPlus Library Preparation Kit (Kapa Biosystems, product #KK8514). To add diversity in the library, the samples were spiked with 15% PhiX Control purchased from Illumina, Inc. (product #FC-110-3001). The library was then loaded onto Illumina's 600 cycle MiSeqR Reagent Kit v3 (Illumina, product #MS-102-3003) and run on the MiSeqR instrument.

Reformatting and High Throughput (HT) IgG Purification

Expi293 cells were transfected using Expifectamine (ThermoFisher, A14524) with the heavy chain and light chain DNA at a 2:1 ratio and supernatants were harvested 4 days post-transfection before cell viability dropped below 80%. Purifications were undertaken using either King Fisher (ThermoFisher) with protein A magnetic beads or Phynexus protein A column tips (Hamilton). For large scale production of IgG clones that were evaluated in in vivo mouse studies, an Akta HPLC purification system (GE) was used.

IgG characterization and quality control. The purified IgGs for the positive GLP-1R binders (hits) were subjected to characterization for their purity by LabChip GXII Touch HT Protein Express high-sensitivity assay. Dithiothreitol (DTT) was used to reduce the IgG into VH and VL. IgG concentrations were measured using Lunatic (UnChain). IgG for in vivo mouse studies were further characterized by HPLC and tested for endotoxin levels (Endosafe® nexgen-PTS™ Endotoxin Testing, Charles River), with less than 5 EU per kg dosing.

Binding Assays and Flow Cytometry

GLP-1R IgG clones were tested in a binding assay coupled to flow cytometry analysis as follows: FLAG-GLP-1R-GFP expressing CHO cells (CHO-GLP-1R) and CHO-parent cells were incubated with 100 nM IgG for 1 h on ice, washed three times and incubated with Alexa 647 conjugated goat-anti-human antibody (1:200) (Jackson ImmunoResearch Laboratories, 109-605-044) for 30 min on ice, followed by three washes, centrifuging to pellet the cells between each washing step. All incubations and washes were in buffer containing PBS+1% BSA. For titrations, IgG was serially diluted 1:3 starting from 100 nM down to 0.046 nM. Cells were analyzed by flow cytometry and hits (a hit is an IgG that specifically binds to CHO-GLP-1R) were identified by measuring the GFP signal against the Alexa 647 signal. Flow cytometry data of binding assays with 100 nM IgG are presented as dot plots. Analyses of binding assays with IgG titrations are presented as binding curves plotting IgG concentrations against MFI (mean fluorescence intensity).

Ligand Competition Assay

Ligand competition assays involved co-incubating the primary IgG with 1 μM GLP-1 (7-36). For each data point, IgG (600 nM) was prepared in Flow buffer (PBS+1% BSA) and diluted 1:3 down for 8 titration points. Peptide GLP-1 7-36 (2 μM) was prepared similarly with the Flow buffer (PBS+1% BSA). Each well contained 100,000 cells to which 50 μL of IgG and 50 μL of peptide (=plus) or buffer alone without peptide (=minus) were added. Cells and IgG/peptide mix were incubated for 1 hr on ice, and after washing, secondary antibody (goat anti-human APC, Jackson ImmunoResearch Laboratories, product #109-605-044) diluted 1:200 in PBS+1% BSA was added. This was incubated on ice for 30 mins (50 μL per well), before washing and resuspending in 60 μL buffer. Finally, the assay read-out was measured on an Intellicyt® IQue3 Screener at a rate of 4 seconds per well.

Cell-Based Functional Assays

CAMP assays. GLP-1R IgG clones were tested for their potential effects on GLP-1R signaling by performing cAMP assays obtained from Eurofins DiscoverXX. The technology involved in detecting cAMP levels is a no wash gain-of-signal competitive immunoassay based on Enzyme Fragment Complementation technology. Experiments were designed to test for either agonist or antagonist activity of the IgG clones. To test for agonist activity of the IgGs, cells were stimulated with IgG incubating for 30 min at 37° C. (titrations 1:3 starting from 100 nM and diluting down to 0.046 nM with PBS) or with the known agonist GLP-1 7-36 peptide (MedChemExpress, Cat. No.: HY-P005), titrated 1:6 starting from 12.5 nM and diluting down to 0.003 nM with PBS. To test for antagonist activity, cells were incubated with IgG at a fixed concentration of 100 nM for 1 h at room temperature to allow binding, followed by stimulation with GLP1 7-36 peptide (titrations 1:6 starting from 12.5 nM down to 0.003 nM in PBS) for 30 min at 37° C. Intracellular CAMP levels were detected by following the assay kit instructions.

Beta arrestin recruitment assy. β-arrestin recruitment assay was obtained from Eurofins DiscoverXX (Cat #93-0300E2) that utilized untagged GLP-1R overexpressing CHO-K1 cells. The experiment is to test if GLP1R-3 has an effect on GLP-1 7-36 agonist induced β-arrestin recruitment upon GLP-1R activation. Expanded cells were seeded into 96 well plates at 5,000 cells/well, and the experiment was performed 48 hours after plating cells. 100 nM IgG was pre-incubated for 1 hour at RT with plated cells in 50 ul volume, and then 5 ul of ligand GLP-1 7-36 was added for a further incubation for 30 min at 37° C. Add 22.5 uL of detection solution to each well, tap gently and briefly spin down. Then incubate plates at RT for 1 hour in the dark. The plates were then read by a Chemiluminescence plate reader, Molecular Devices SpectraMax® M5, and output relative light units (RLU) data were analyzed using GraphPad Prism™.

In Vivo Studies

Animals. All animal procedures were approved by Institutional Animal Care and Use Committee (IACUC) at the University of California San Francisco and were conducted in accordance with the National Institutes of Health Guide for the Care and Use of laboratory Animals. C57BL/6NHsd (Envigo RMS, LLC) male littermates at 8-10 weeks of age, weighing ~20-28 grams, were used in all the studies described. The mice were housed in a room that was temperature (22-25 C) and light controlled (12-h: 12-h light/dark cycle starting at 7 AM. The mice were fed with chow diet with 9% fat (PicoLab mouse Diet 20 (#5058), Lab Supply, Fortworth Texas, USA) for the duration of housing at the UCSF animal care facility.

Monoclonal Antibodies and Reagents. Anti-GLP-1 monoclonal antibodies (mAb) in PBS buffer were tested in these studies an agonist mAb, GLP1R-59-2 and one antagonist mAb, GLP1R-3. Mice were dosed prior to a Glucose Tolerance Test (GTT) or an Insulin Tolerance test (ITT) using the following regimen: Agonist GLP1R-59-2 mAb was dosed at 5 or 10 mg/kg at three different administration regimen groups prior to performing a GTT and with four different administration regimen groups in an Insulin Tolerance test (ITT). 1. mAb administered as a single dose, 15 hours prior to GTT and 21 hours prior to ITT. 2. mAb administered as a double dose, 15 hours prior to GTT and 21 hours prior to ITT plus a second mAb dose 2 hours prior to GTT and ITT. 3. mAb single dose 2 hours prior to GTT and ITT. 4. mAb single dose 6 hours prior to ITT only.

Antagonist GLP1R-3 mAb was dosed at 20 mg/kg at four different administration regimen groups. 1. mAb administered as a single dose, 15 hours prior to GTT and 21 hours prior to ITT. 2. mAb administered as a double dose, 15 hours prior to GTT and 21 hours prior to ITT plus a second mAb dose 2 hours prior to GTT and ITT. 3. mAb as a single dose 6 hours prior to GTT and ITT. 4. mAb single dose 2 hours prior to GTT and ITT.

Extendin 9-39 Peptide (MedChemExpress, Cat. No.: HY-P0264) were dosed at 1.0 or 0.23 mg/kg at three different administration regimen groups. 1. Extendin administered as a single dose, 21 hours prior to ITT. 2. Extendin administered as a double dose, 21 hours prior to ITT plus a second Extendin dose 2 hours prior to ITT. 3. mAb as a single dose 6 hours prior to ITT.

Glucose Tolerance Test

A Glucose Tolerance Test (GTT) was used to assess two different anti-GLP1 mAbs (Agonist and Antagonist) effect on glucose tolerance following an acute glucose administration. Intraperitoneal Glucose Tolerance Test (IP-GTT) was conducted in 8 or 10-week old male mice to assess glucose disposal after a glucose injection and measuring blood glucose level after mice were fasted overnight (14-16 hours). To avoid circadian variations in mouse blood glucose levels this testing was performed at fixed times. Mice were weighed after the overnight fast and baseline blood glucose levels (pre-glucose injection; Time 0 minutes) were measured. Mice were injected, i.p., with a single bolus (10 ul/gram body weight) of 30% Dextrose solution (Hospira, Illinois) and blood glucose levels were measured at 15, 30, 60, 120 and 180-minutes post glucose administration. Blood samples were obtained by a tail nick and blood glucose levels were monitored using a OneTouch Ultra 2 glucose monitor (LifeScan, Inc.)

Insulin Tolerance Test

An Insulin Tolerance Test (ITT) was conducted to assess two different anti-GLP1 mAbs (agonist and antagonist) effect on insulin sensitivity following acute insulin administration. 8 or 10-week old male mice were fasted for 6 hours and body weight was recorded before and after fasting. To avoid circadian variations in mouse blood glucose levels this testing was performed at fixed times. Blood samples were collected by tail nick and baseline glucose was measured prior to insulin injection. Mice were injected, i.p., with a single bolus (0.75 U/Kg body weight) of human insulin (Novolin, Novo Nordisk) and blood glucose levels were measured at 15, 30, 45, 60 and 120 minutes after insulin injection. Blood glucose levels were monitored using a OneTouch Ultra 2 glucose monitor (LifeScan, Inc.).

ELISA for Pharmacokinetic (PK) Studies.

The rat PK study was done at Charles River Laboratories, One Innovation Dr, 3 Biotech, Worcester, MA 01605. 5 Male Sprague-Dawley rats per group were allowed to acclimate after receiving at test facility for a minimum of 3 days before dosing. GLP1R-3 and GLP1R59-2 were dosed at 10 mg/kg by IV in 100 mM Hepes, 100 mM NaCl, 50 mM NaAc, pH 6.0 vehicle. Serial blood samples were collected via jugular vein cannula with ~250 ul volume at each time point: pre-dose, 0.0833, 0.25, 0.5, 1, 2, 4, 8, 24, 48, 72, 96, 168, 240 and 336 hours post dose. Blood samples were collected into $K_2$EDTA tubes and stored on wet ice until processed to plasma by centrifugation (3500 rpm for 10 minutes at 5° C.) within 30 minutes of collection. Plasma samples were then transferred into an appropriate tube containing DPP-4 (3.3 μL for 100 μL of plasma) and frozen on dry ice. To measure the human IgG in rat plasma samples, sheep anti-Human IgG (1 mg/mL) was used as coating reagent) (The binding site, Lot No. AU003.M), and goat anti-Human IgG, HRP (H&L) (1 mg/mL) was used as detection reagent) (Bethyl, cat #A80-319P) in an ELISA assay. Stock solutions of human IgG standards and QCs were prepared by spiking human IgG into rat plasma. A minimum of two wells were used to analyze each study samples, QC's, standards, and blank. A 4-parameter logistic (4PL) model was used to fit the sigmoid calibration curve. The semi-logarithmic sigmoid calibration curve was obtained by plotting the absorbance response against concentration. Concentrations of analyte in the test samples were determined by computer interpolation from the plot of the calibration curve.

Results

Design of GPCR-Focused Antibody Library is Based on GPCR Binding Motifs and GPCR Antibodies All known GPCR interactions, which include interactions of GPCRs with ligands, peptides, antibodies, endogenous extracellular loops and small molecules were analyzed to map the GPCR binding molecular determinants. Crystal structures of almost 150 peptides, ligand or antibodies bound to ECDs of around 50 GPCRs (gpcrdb.org) were used to identify GPCR binding motifs. Over 1000 GPCR binding motifs were extracted from this analysis. In addition, by analysis of all solved structures of GPCRs (Zhang Lab at University of Michigan), over 2000 binding motifs from endogenous extracellular loops of GPCRs were identified. Finally, by analysis of structures of over 100 small molecule ligands bound to GPCR, a reduced amino acid library of 5 amino acids (Tyr, Phe, His, Pro and Gly) that may be able to recapitulate many of the structural contacts of these ligands was identified. A sub-library with this reduced amino acid diversity was placed within a CxxxxxC motif. In total, over 5000 GPCR binding motifs were identified (FIGS. 9A-9E). These binding motifs were placed in one of five different stem regions:

CARDLRELECEE-WTxxxxxSRGPCVDPRGVAGSFDVW (SEQ ID NO: 1523),

CARDMYYDFxxxxxEVVPADDAFDIW (SEQ ID NO: 1524),

CARDGRGSLPRPKGGPxxxxxYDSSEDSGGAFDIW (SEQ ID NO: 1525),

CARANQHFxxxxxGYHYYGMDVW (SEQ ID NO: 1526),

CAKHMSMQxxxxxRADL VGDAFDVW (SEQ ID NO: 1527).

These stem regions were selected from structural antibodies with ultra-long HCDR3s. Antibody germlines were specifically chosen to tolerate these ultra-long HCDR3s. Structure and sequence analysis of human antibodies with longer than 21 amino acids revealed a V-gene bias in antibodies with long CDR3s. Finally, the germline IGHV (IGHV1-69 and IGHV3-30), IGKV (IGKV1-39 and IGKV3-15) and IGLV (IGLV1-51 and IGLV2-14) genes were chosen based on this analysis.

Figure 10:
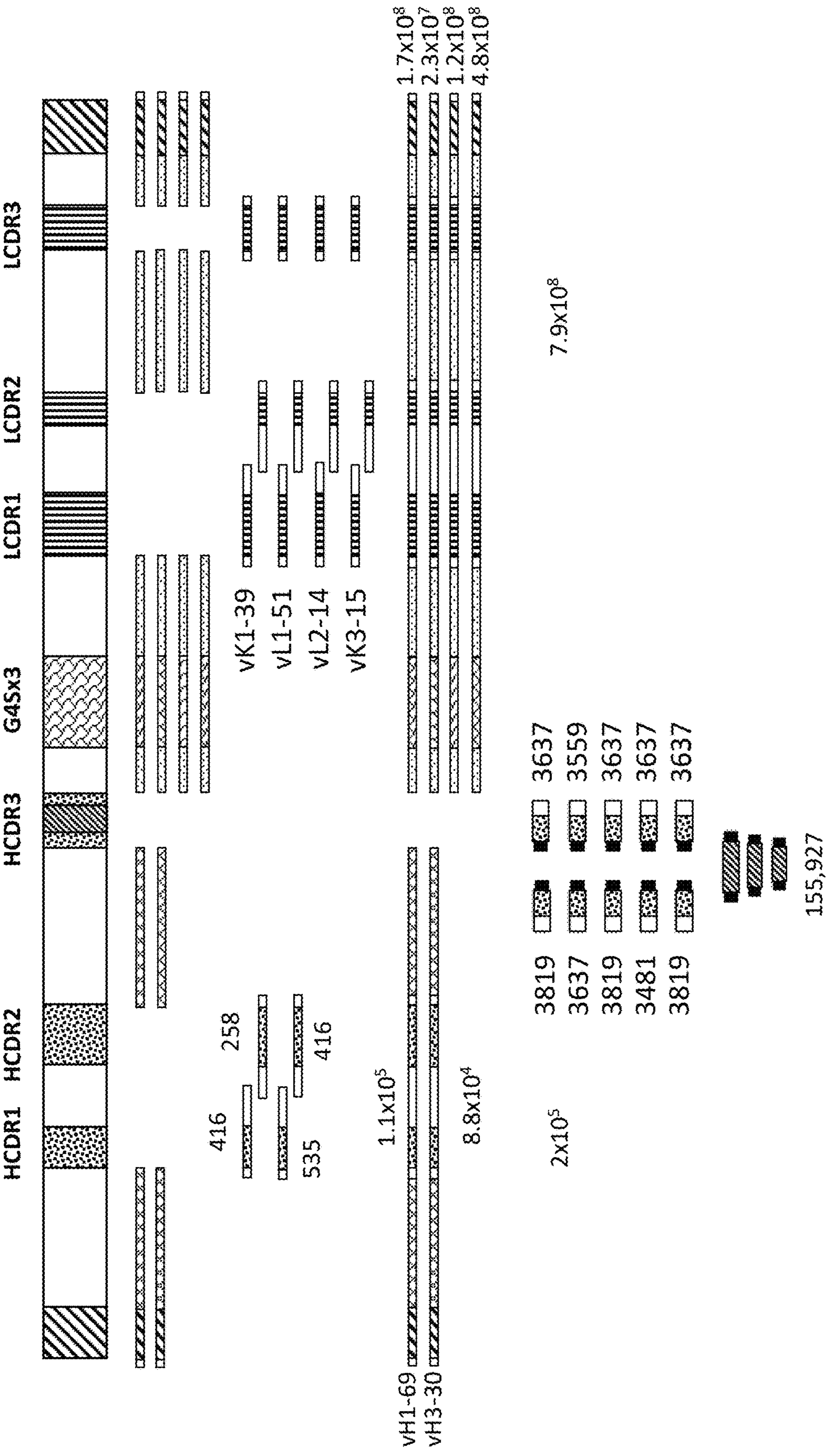
FIG. 10 depicts a schema of the GPCR focused library design. Two germline heavy chain VH1-69 and VH3-30; 4 germline light chain IGKV1-39 and IGKV3-15, and IGLV1-51 and IGLV2-14.
Figure 11:
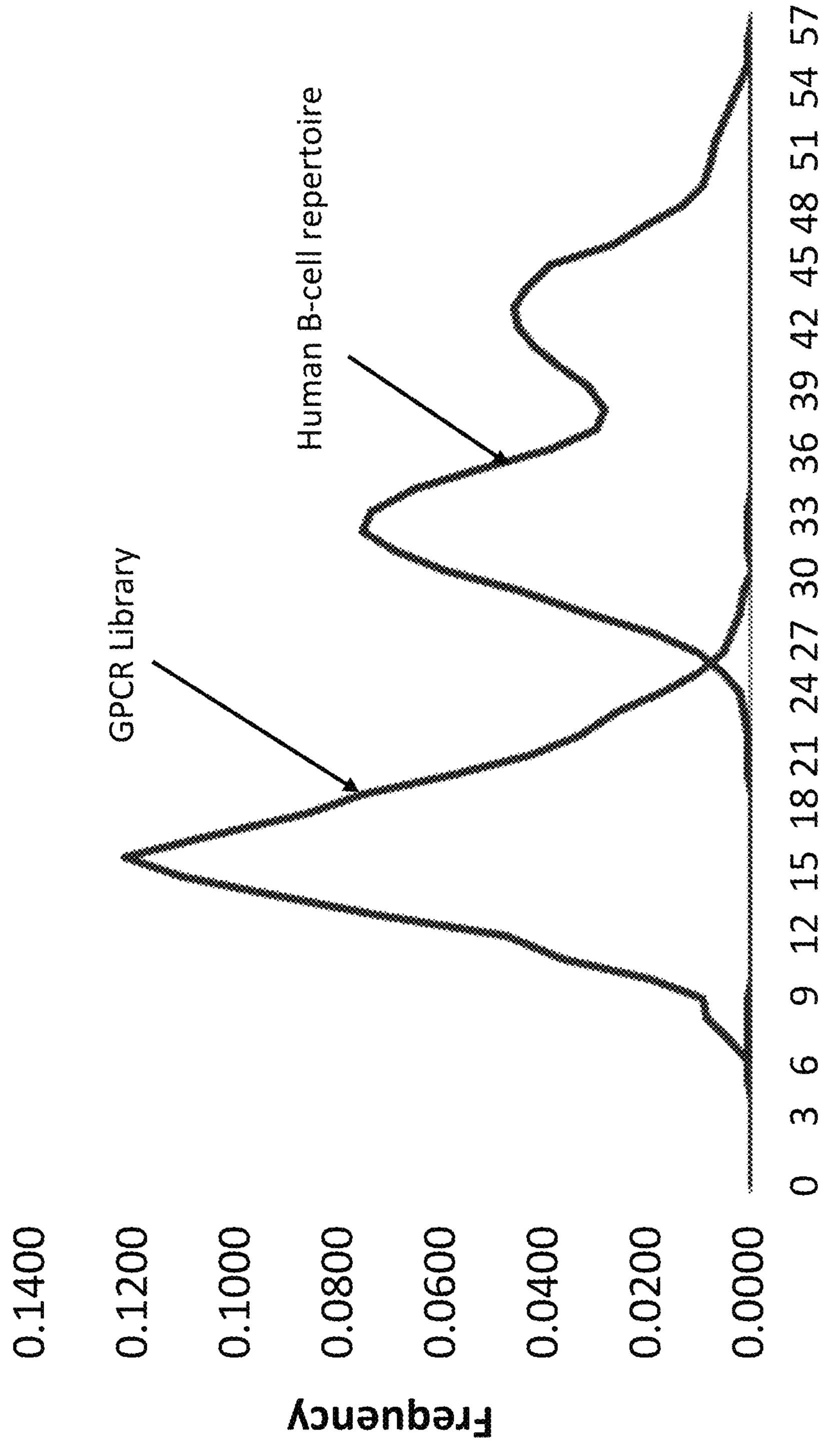
FIG. 11 depicts a graph of HCDR3 length distribution in the GPCR-focused library compared to the HCDR3 length distribution in B-cell populations from three healthy adult donors. In total, 2,444,718 unique VH sequences from the GPCR library and 2,481,511 unique VH sequences from human B-cell repertoire were analyzed to generate the length distribution plot.

In addition to HCDR3 diversity, limited diversity was also introduced in the other 5 CDRs. There were 416 HCDR1 and 258 HCDR2 variants in the IGHV1-69 domain; 535 HCDR1 and 416 HCDR2 variants in the IGHV3-30 domain; 490 LCDR1, 420 LCDR2 and 824 LCDR3 variants in the IGKV1-39 domain; 490 LCDR1, 265 LCDR2 and 907 LCDR3 variants in the IGKV3-15 domain; 184 LCDR1, 151 LCDR2 and 824 LCDR3 variants in the IGLV1-51 domain; 967 LCDR1, 535 LCDR2 and 922 LCDR3 variants in the IGL V2-14 domain (FIG. 10). These CDR variants were selected by comparing the germline CDRs with the near-germline space of single, double and triple mutations observed in the CDRs within the V-gene repertoire of at least two out of 12 human donors. All CDRs have were pre-screened to remove manufacturability liabilities, cryptic splice sites or nucleotide restriction sites. The CDRs were synthesized as an oligo pool and incorporated into the selected antibody scaffolds. The heavy chain (VH) and light chain (VL) genes were linked by (G4S) 3 linker (SEQ ID NO: 1520). The resulting scFv (VH-linker-VL) gene pool was cloned into a phagemid display vector at the N-terminal of the M13 gene-3 minor coat protein. The final size of the GPCR library is $1\times10^{10}$ in a scFv format. Next-generation sequencing (NGS) was performed on the final phage library to analyze the HCDR3 length distribution in the library for comparison with the HCDR3 length distribution in B-cell populations from three healthy adult donors. The HCDR3 sequences from the three healthy donors used were derived from a publicly available database with over 37 million B-cell receptor sequences[31]. The HCDR3 length in the GPCR library is much longer than the HCDR3 length observed in B-cell repertoire sequences. On average, the median HCDR3 length in the GPCR library (which shows a biphasic pattern of distribution) is two or three times longer (33 to 44 amino acids) than the median lengths observed in natural B-cell repertoire sequences (15 to 17 amino acids) (FIG. 11). The biphasic length distribution of HCDR3 in the GPCR library is mainly caused by the two groups of stems (8aa, 9aaxxxxx10aa, 12aa) and (14aa, 16aa xxxxx 18aa, 14aa) used to present the motifs within HCDR3.

Figure 12A:
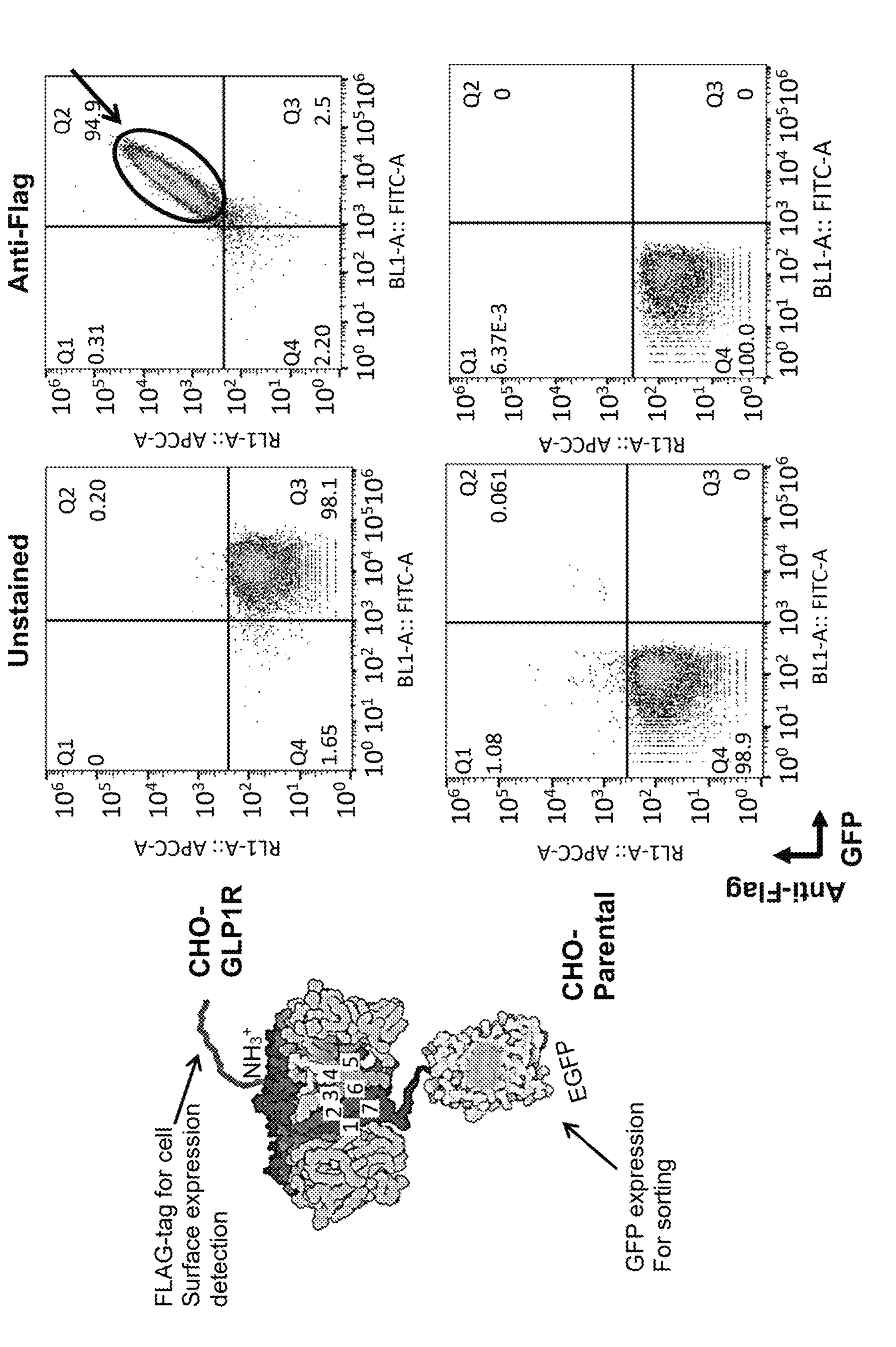
FIG. 12A depicts the design of the over-expressing GLP-1R CHO cells for the phage antibody library selection. GLP-1R expression was confirmed by the gating of double detection of GFP green fluorescence and the surface expression of Flag tag on the cell surface.
Figure 12B:
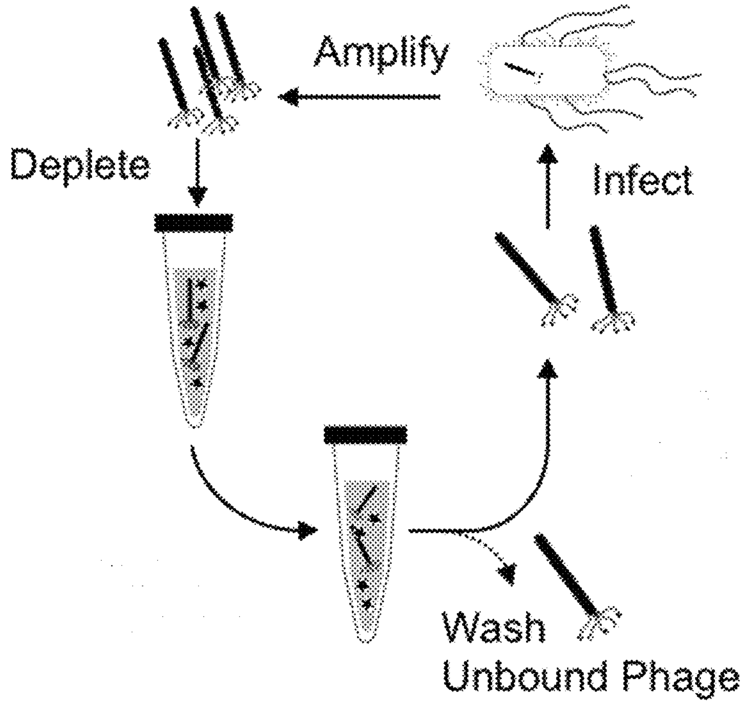
FIG. 12B depicts a cell-based panning process.
Figure 13:
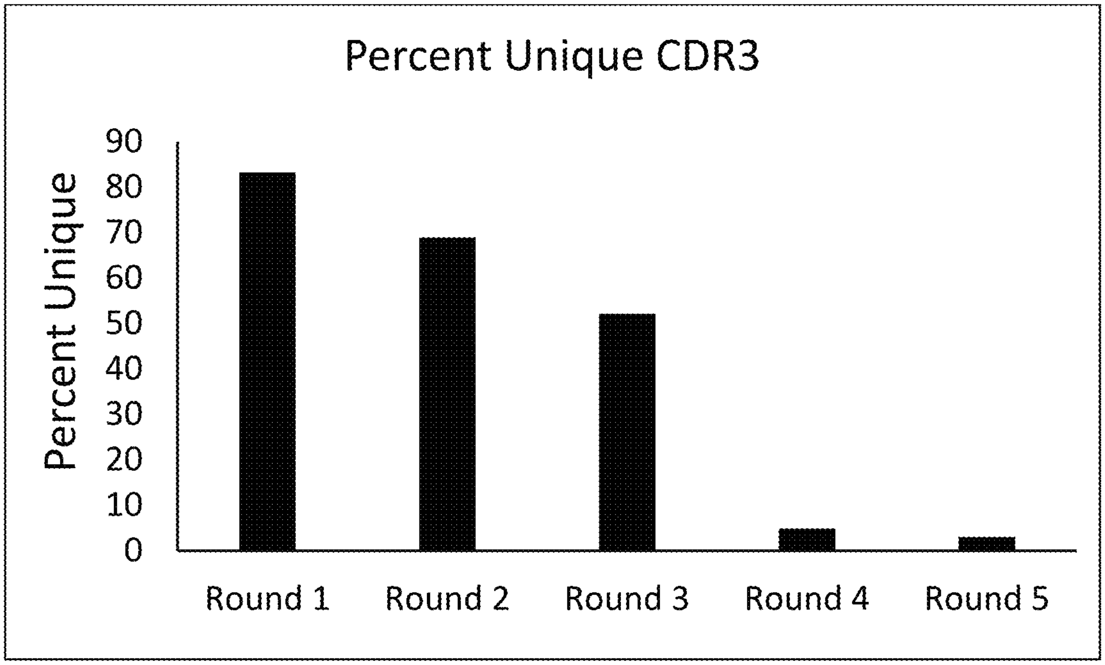
FIG. 13 depicts a graph of percent unique HCDR3 in the output pools of the five GLP-1R panning rounds.

Phage Panning Against GLP-1R Over-Expressing Cell Lines Resulted in Clonal Enrichment A GLP-1R over-expressing CHO stable cell line was created with a FLAG tag presented on the N-terminus of the receptor in order to detect cell surface expression and an EGFP tag on the C-terminus to track total receptor expression. Flow cytometry analysis of these cells confirmed that the majority of the receptor (>80%) was expressed at the cell surface (FIG. 12A). These GLP-1R-expressing CHO cells were used for five rounds of phage panning against the GPCR-focused library. The selection scheme is outlined in FIG. 12B. The variable heavy chain (VH) from the output of each panning round was PCR amplified and sequenced by MiSeq®. As the percent unique HCDR3 decreases in each round output pool NGS sequencing, significant clonal enrichment was observed from round 1 to round 5 (FIG. 13), indicating a target specific clonal selection in the panning process. Approx. 1000 clones in total (from round 4 and round 5) were picked for single clonal NGS sequencing and ~100 unique VH-VL pairs were selected to be reformatted and expressed as full length human IgG2 at 1 ml scale.

Figure 14:
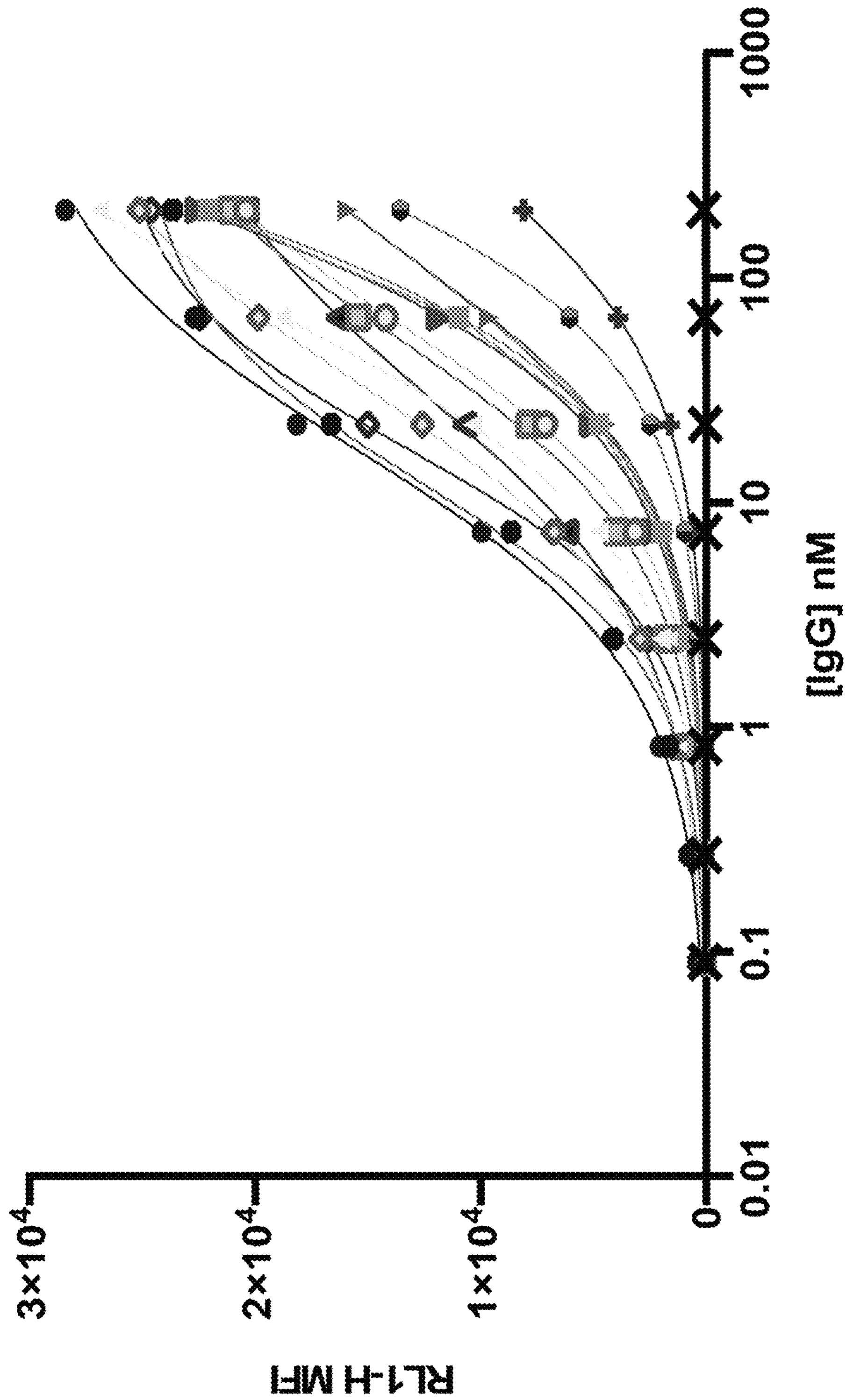
FIG. 14 depicts a graph of binding plots of the 13 unique GLP-1R Hits, compared to the parental CHO cell binding.

IgG Binders Directed to GLP-1R Contain Either GLP-1, GLP-2 or Unique HCDR3 Motifs Identified Purified IgG clones were tested for specific binding to GLP-1R-expressing CHO cells. A single-point flow cytometry analysis using 100 nM of IgG concentration revealed that out of 100 IgG unique clones tested, 13 IgG clones bound specifically to GLP-1R-positive cells (GFP+) and not parental CHO cells (GFP−). The binding of these 13 hits was then further evaluated by 8-point titrations of each IgG clone starting from 200 nM (30 μg/mL) and the cell binding affinities were determined to be in the double-digit nM range. The average CHO parental cell background binding by all 13 IgG clones is shown as a black line and is minimal compared with specific binding to GLP-1R-expressing cells (FIG. 14). Full saturation was not observed, the plateau of the binding curve at the highest concentration, 200 nM used in the experiment. FIG. 15 shows the HCDR3 amino acid sequences of these 13 IgG clones. Six of these were found to include a GLP-1 motif, four included a GLP-2 motif, and three had unknown motif.

Eight IgGs of the 13 Binders are Negative Antagonists in GLP-1R Mediated cAMP Signaling The 13 IgG binders were next assessed for their functional activity in the CAMP signaling pathway by using GLP-1R over-expressing CHO-K1 cells purchased from DiscoverX that are designed and validated for assessing GLP-1R-induced cAMP signaling. In the first instance, the IgG clones were tested for agonist activity as compared with the peptide agonist GLP-1 7-36 in dose titrations. While GLP-1 7-36 stimulation resulted in a cAMP signal, none was observed for the IgG clones, indicating that they are not activating. Subsequently, the panel of IgG clones were tested for antagonist activity by pre-incubating GLP-1R-expressing cells with a fixed concentration of IgG to allow binding to occur and then stimulating the cells with GLP-1 7-36 in a dose dependent manner. This allowed examination of the impact of the presence of IgG on GLP-1 7-36-induced GLP-1R CAMP signaling, thereby potentially revealing any potential competitive effects of the IgG. It was observed that the GLP-1 7-36 dose response curve shifted to the right in the presence of 8 out of the 13 IgG clones, suggesting that they act as negative antagonists of the GLP-1 7-36 response (data not shown). Similar observations were made regarding the effect of the 13 IgG clones on Exendin-4 induced GLP-1R CAMP signaling response (data not shown). The remaining five IgG clones appeared to have no significant effects on GLP-1R CAMP signaling (data not shown).

Characterization of Mechanisms of Action of the Antagonist IgG GLP1R-3

Figure 16A:
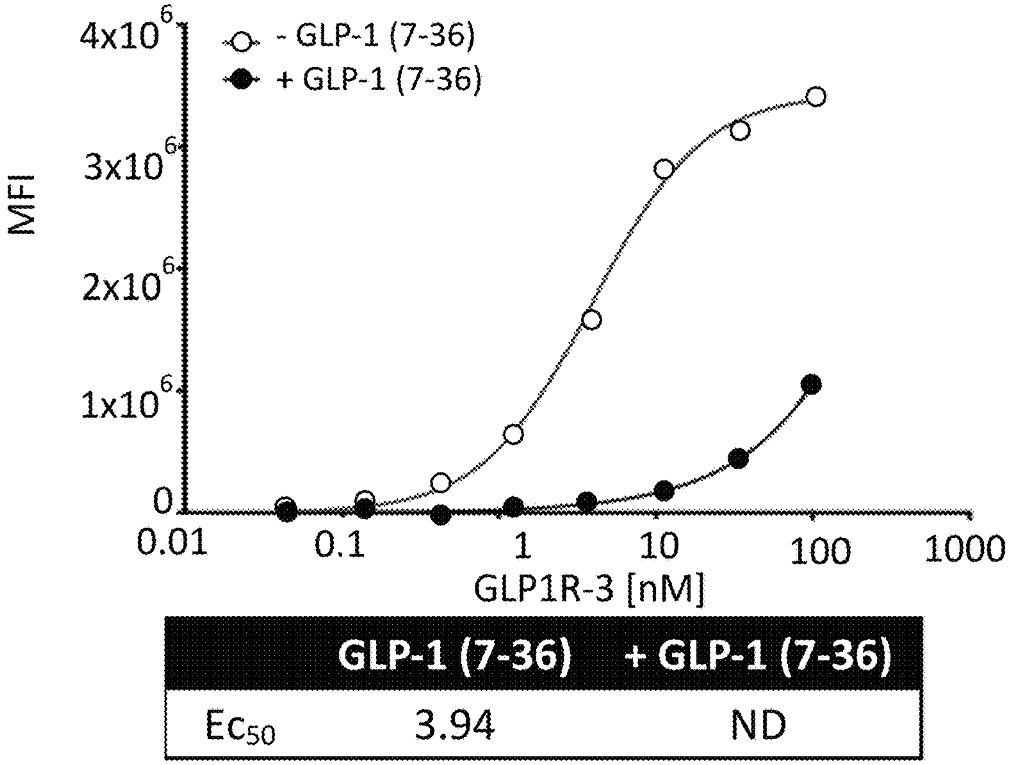
FIG. 16A depicts a graph of orthosteric inhibition of GLP1R-3 binding in the absence and presence of GLP-1 (7-36).

To determine the mechanism of action of these resulting functional hits, subsequent studies focused one of the GLP-1 motif-containing IgG clones that demonstrated high binding affinity, as well as functionality: GLP1R-3. Ligand competition binding assays, the IgG effects on the GLP-1 dose response in cAMP signaling, and beta-arrestin recruitment assays were conducted, resulting in characterization of GLP1R-3 as follows:

Competition with the endogenous ligand in GLP-1R binding assays. To determine if GLP1R-3 binds to the orthosteric site on the receptor, N-terminal FLAG-tagged and C terminal GFP-tagged GLP-1R over-expressing CHO cells were incubated with a dose titration of GLP1R-3 starting at 100 nM in the presence or absence of a fixed concentration of the peptide agonist GLP-1 7-36 (1 μM). Flow cytometry analysis revealed significantly reduced binding of GLP1R-3 to GLP-1R (GFP+) in the presence of GLP-1 7-36. Whilst the presence of GLP-1 7-36 peptide does not completely ablate GLP1R-3 binding, this observation suggests that the antibody may bind to an overlapping epitope, or GLP1R-3 have stronger binding affinity for GLP-1 7-36 to compete for binding. (FIG. 16A).

Figure 16B:
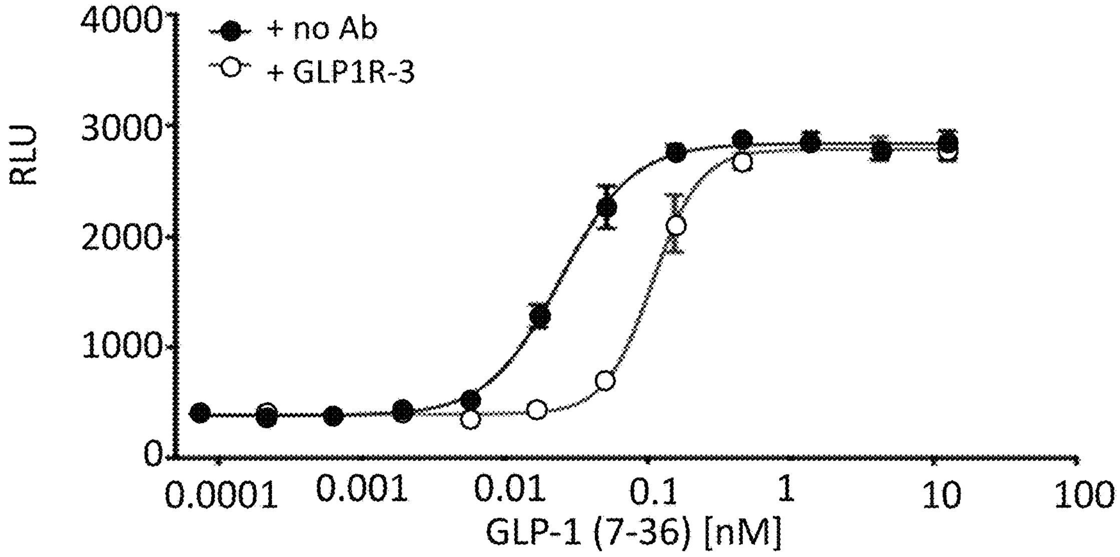
FIG. 16B depicts a graph of effects of GLP1R-3 on GLP-1 activation in the CAMP assay.

GLP1R-3 antagonizes GLP-1 activated cAMP signaling. The next step was to determine if GLP1R-3 exhibits competitive antagonism for GLP-1R in a dose-dependent manner. GLP-1 7-36-induced cAMP signaling was examined in the presence of a constant concentration (100 nM) of GLP1R-3 with a dose titration of GLP-1 7-36 starting at 20 nM with a 3-fold down titration, and a clear dose-dependent inhibition of the CAMP signal was observed. The EC50 for GLP-1 7-36 peptide is 0.025 nM without presence of GLP1R-3, and 0.11 nM in the presence of 100 nM GLP1R-3 (FIG. 16B), supporting that GLP1R-3 is a competitive antagonist.

Figure 16C:
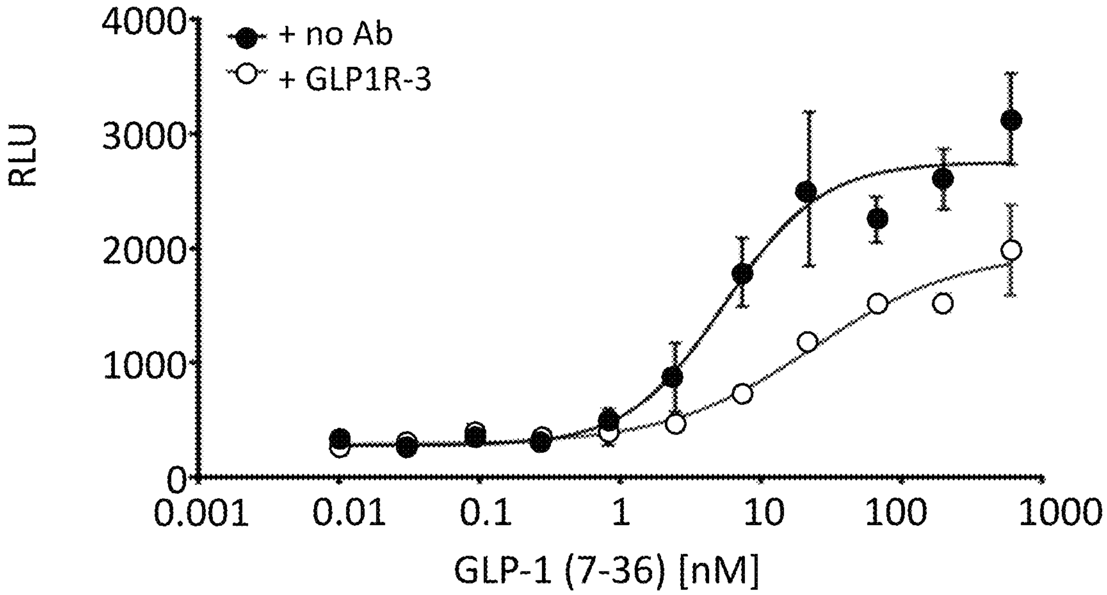
FIG. 16C depicts a graph of effects of GLP1R-3 on GLP-1 induced β-arrestin recruitment.

GLP1R-3 reduces β-arrestin recruitment upon GLP-1R activation. When a GPCR is activated by an agonist, β-arrestins are recruited to the GPCR from the cytosol, thereby excluding the receptor from further G protein interactions and leading to signal arrest, hence the name "arrestin". To determine if GLP1R-3 had any effects on β-arrestin recruitment by activated GLP-1R, GLP-1R over-expressing CHO-K1 cells (DiscoverX) that are specifically designed and validated for assessing GLP-1R β-arrestin recruitment were employed in the following manner. Cells were pre-incubated with a fixed concentration of GLP1R-3 (100 nM) for 1 hr at room temperature to allow binding to occur and then stimulated with GLP-1 7-36. GLP1R-3, showed inhibition of GLP-1 7-36 peptide-induced beta arrestin recruitment to GLP-1R as evidenced by the right shift of GLP-1 7-36 dose response curve for β-arrestin recruitment (FIG. 16C). This indicated that GLP1R-3 reduces β-arrestin recruitment to GLP-1R, which is consistent with the observed reduced receptor activation. Thus, these cell-based assays indicate that GLP1R-3 is a competitive antagonist to GLP-1 7-36 for GLP-1R.

Design and Characterization of a GLP-1R Agonist IgG GLP1R-59-2

Figure 17:
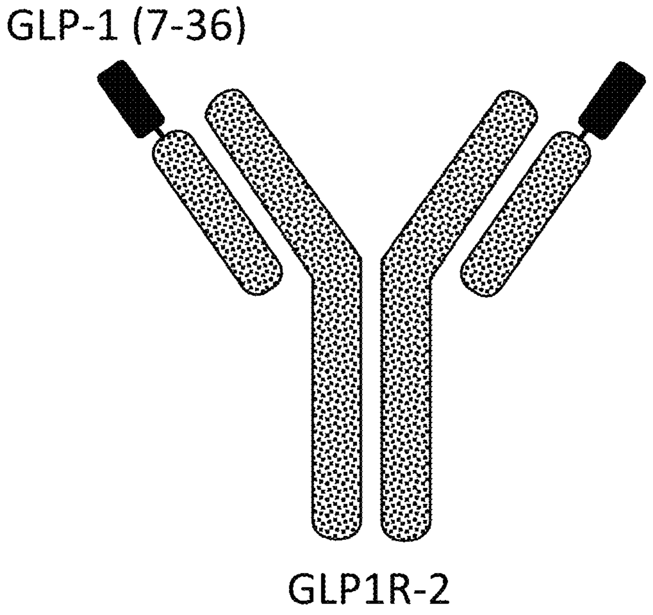
FIG. 17 depicts a design of GLP1R-59-2. The GLP1 (7-36) peptide (SEQ ID NO: 1528) was linked to the N-terminal of light chain of the functionally inactive GLP-1R binding antibody GLP1R-2.
Figure 18A:
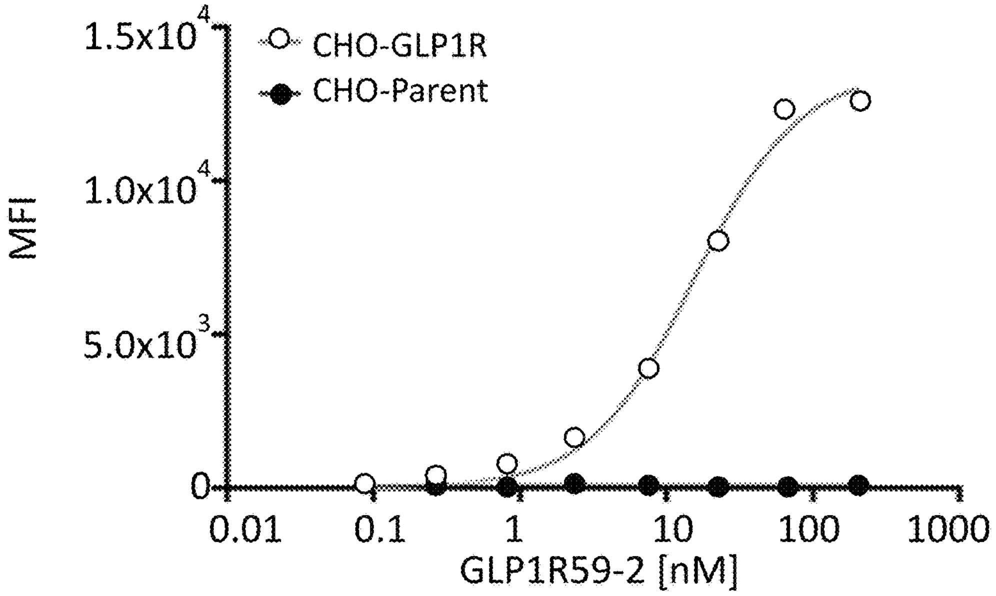
FIG. 18A depicts a graph of GLP1R-59-2 binding specifically to the GLP-1R with an EC50 of 15.5 nM.

Since none of the 13 IgG hits showed any agonist activity, a GLP-1R agonist antibody (GLP1R-59-2) by linking the native GLP-1 7-36 peptide to the light chain N-terminal of a functionally inactive but GLP-1R-specific binder GLP1R-2 (FIG. 17) was engineered. GLP-1R binding assays, cAMP assays, and β-arrestin recruitment assays were conducted, resulting in characterization of GLP1R-59-2 as described here:

GLP1R-59-2 specifically binds to GLP-1R-expressing CHO cells. Flow cytometry analysis revealed that GLP1R-59-2 bound specifically to GLP-1R-positive cells (GFP+) and not parental CHO cells (GFP−), specific binding was also confirmed by GLP1R-59-2 dose titrations producing an apparent binding $EC_{50}$ of 15.5 nM (FIG. 18A).

Figure 18B:
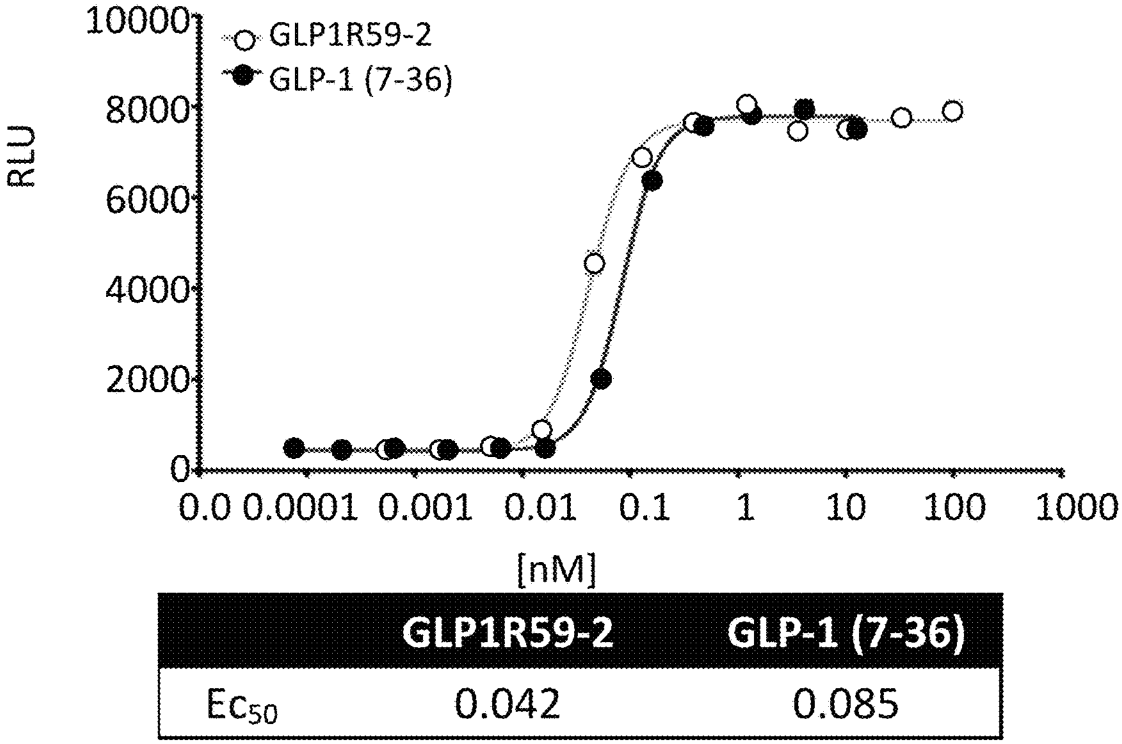
FIG. 18B depicts a graph of GLP1R-59-2 in the CAMP assay with a similar EC50 as the GLP-1 7-36 peptide.

GLP1R-59-2 induces a GLP-1R CAMP response similar to GLP-1 7-36. GLP1R-59-2 was tested for agonist activity as compared with GLP-1 7-36 for stimulating GLP-1R over-expressing CHO-K1 cells (DiscoverX) with separate dose titration analyses conducted for both ligand and antibody. It was found that both induced similar cAMP signaling profile and their dose response curves had almost overlapping EC50 values, 0.042 nM for GLP1R-59-2 and 0.085 nM for GLP-1 7-36. (FIG. 18B) supporting the hypothesis that GLP1R-59-2 can act as an effective agonist for GLP-1R.

Figure 18C:
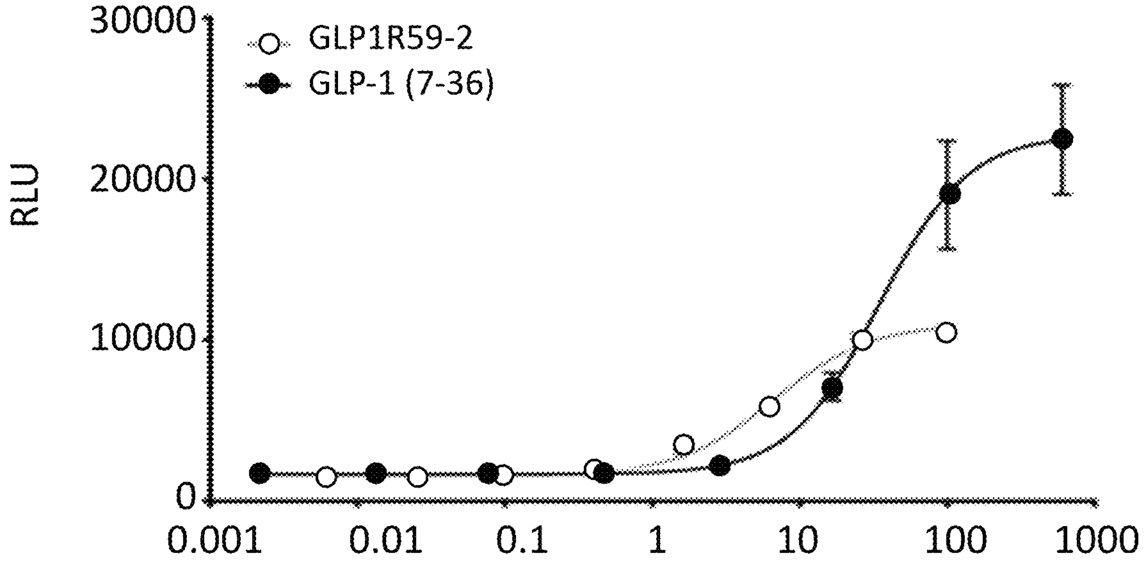
FIG. 18C depicts a graph of GLP1R-59-2 on inducing the β-arrestin recruitment in GLP-1R expression cells.

GLP1R-59-2 is less efficacious for β-arrestin recruitment to GLP-1R than GLP-1 7-36. To determine if GLP1R-59-2 was able to induce a similar level of β-arrestin recruitment to GLP-1R as GLP-1 7-36, GLP-1R over-expressing CHO-K1 cells (DiscoverX) were stimulated with dose titrations of each. It was found that less β-arrestin recruitment occurred with GLP1R-59-2 stimulation than with GLP-1 7-36 stimulation (FIG. 18C). Whilst GLP1R-59-2 is less efficacious than GLP-1 7-36 for the maximal β-arrestin recruitment, it would appear that the agonist IgG is slightly more potent with an EC50 of 0.042 nM, and 0.085 nM for GLP-1 7-36, respectively.

In Vivo PK and PD Testing of GLP1R-3 and GLP1R-59-2

Figure 19A:
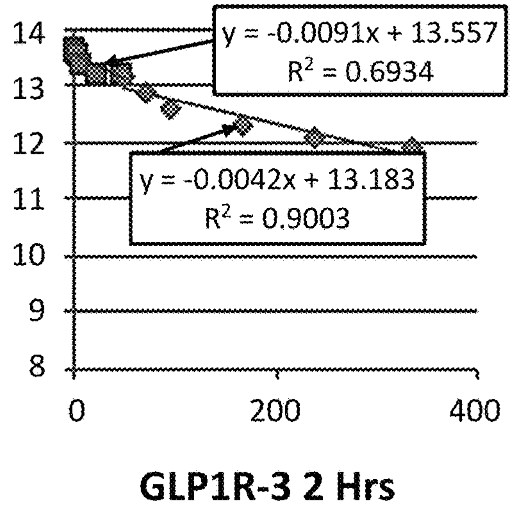
FIGS. 19A-19B depict in vivo pharmacokinetic (PK) and pharmacodynamic (PD) effects of GLP1R-3 and GLP1R-59-2. Based on the beta phase calculation, GLP1R-3 has a 1-week half-life in rat (FIG. 19A). GLP1R-59-2 has a 2-day half-life in rat (FIG. 19B).
Figure 19B:
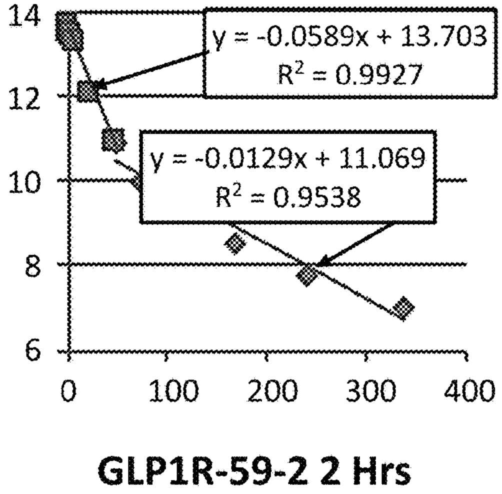

Endogenous GLP-1 peptide has a very short serum half-life of only a few minutes, however GLP-1R antibodies can have significantly longer half-lives. This can be a considerable advantage over the current GLP-1 peptide analog therapeutics. An in vivo PK rat study was performed to evaluate the half-life of the antagonist GLP1R-3 and agonist GLP1R-59-2 in IgG format. In a 2-week PK study, GLP1R-3 exhibited an antibody-like in vivo half-life of ~1-week in rats, while the agonist GLP-1 peptide-antibody fusion, GLP1R-59-2 exhibited>2-day half-life in rats (FIGS. 19A-19B). Liraglutide, the approved GLP-1R agonist for the treatment of Type II diabetes has a 13-hour half-life.

Figure 20A:
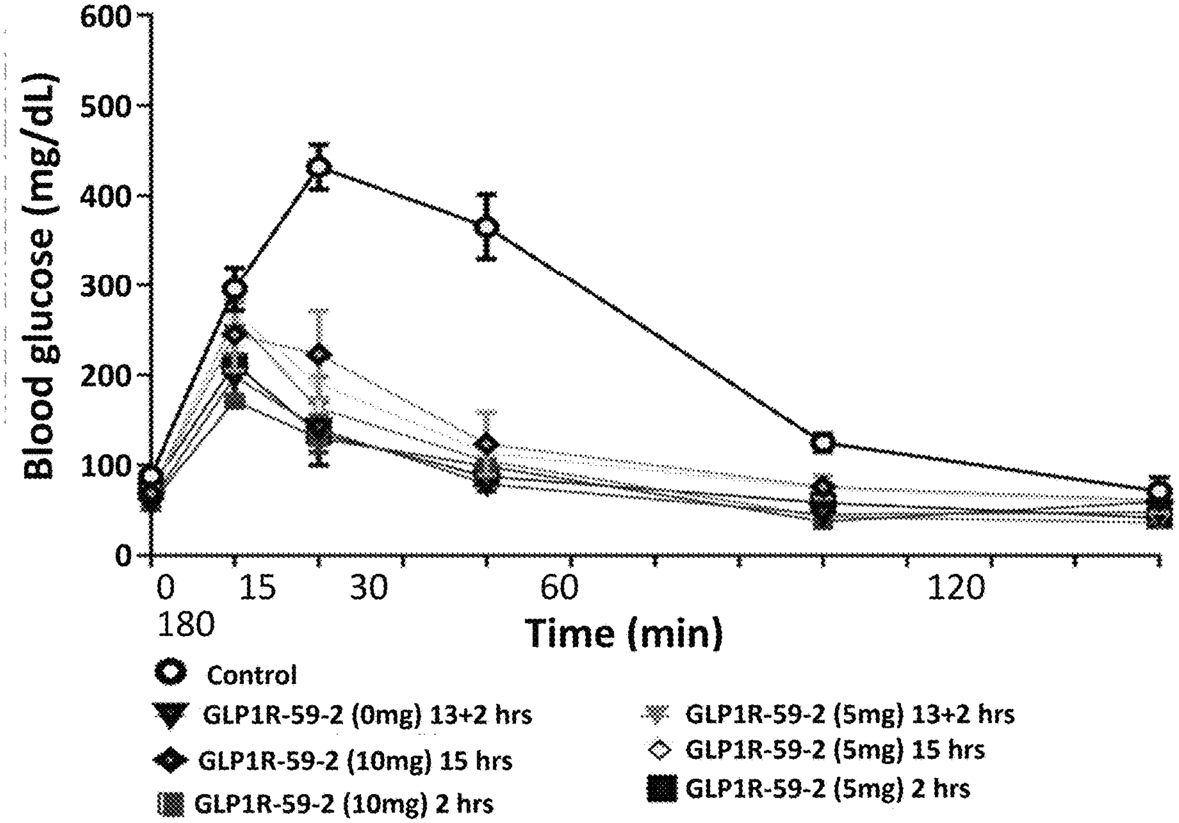
FIG. 20A depicts a graph of GLP1R-59-2 on glucose after glucose challenge.
Figure 20B:
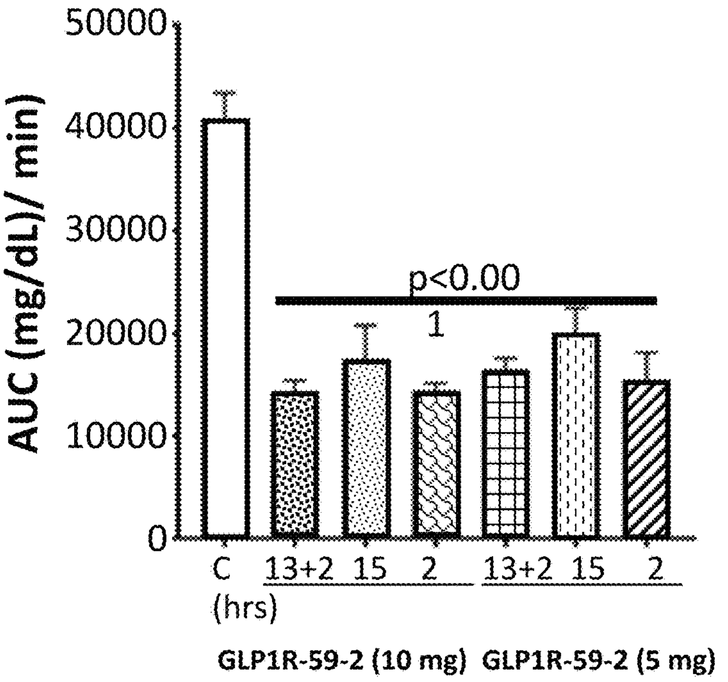
FIG. 20B depicts a graph of Area Under the Curve (AUC) in a glucose tolerance test (GTT).

Agonist GLP1R-59-2 was tested for its in vivo pharmacodynamic (PD) effects in Glucose tolerance test (GTT) using wild-type C57BL/6NHsd mouse model, in comparison with the vehicle control. Agonist mAb GLP1R-59-2 treatment, either dose (5 mg/kg and 10 mg/kg) or dosing regimen (2 hrs, 13+2 hrs, and 15 hrs before glucose challenge), significantly stabilized blood glucose even after a glucose challenge (FIG. 20A). Compared to control mice, GLP1R-59-2 treatments are all significant ($p<0.001$) at reducing Area Under the Curve (AUC) in an GTT (FIG. 20B). However, there is no significant difference between each individual treatment timing or dose.

Figure 21A:
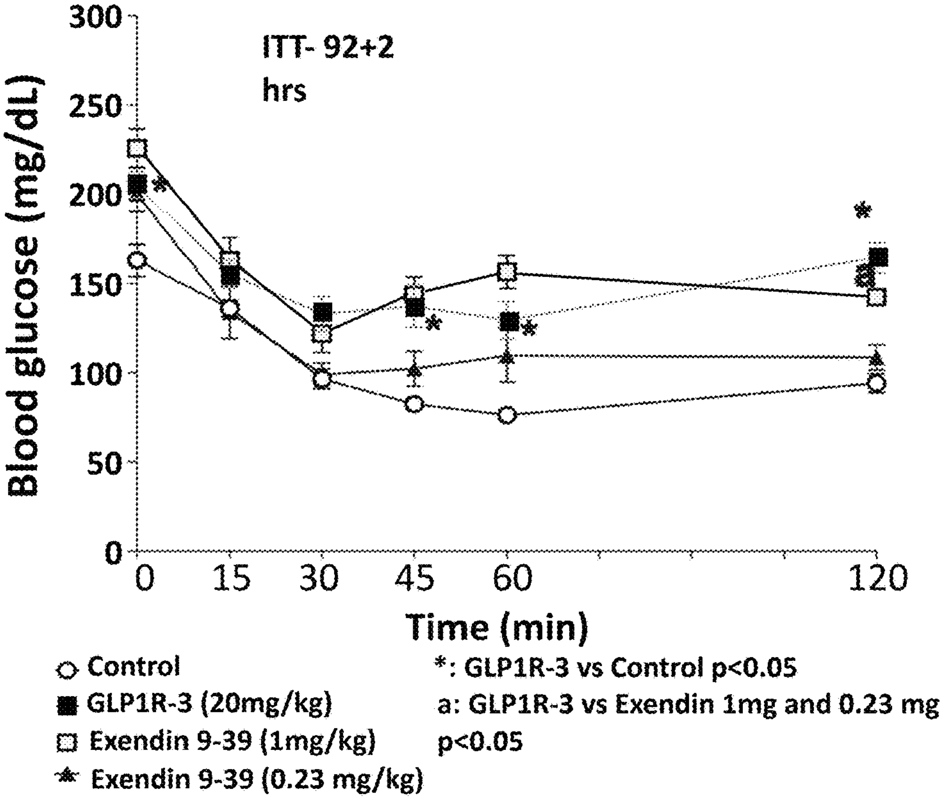
FIG. 21A depicts a graph of GLP1R-3 and GLP-1 peptide Exendin 9-39 treatment, 19+2 hour dosing regimen
Figure 21B:
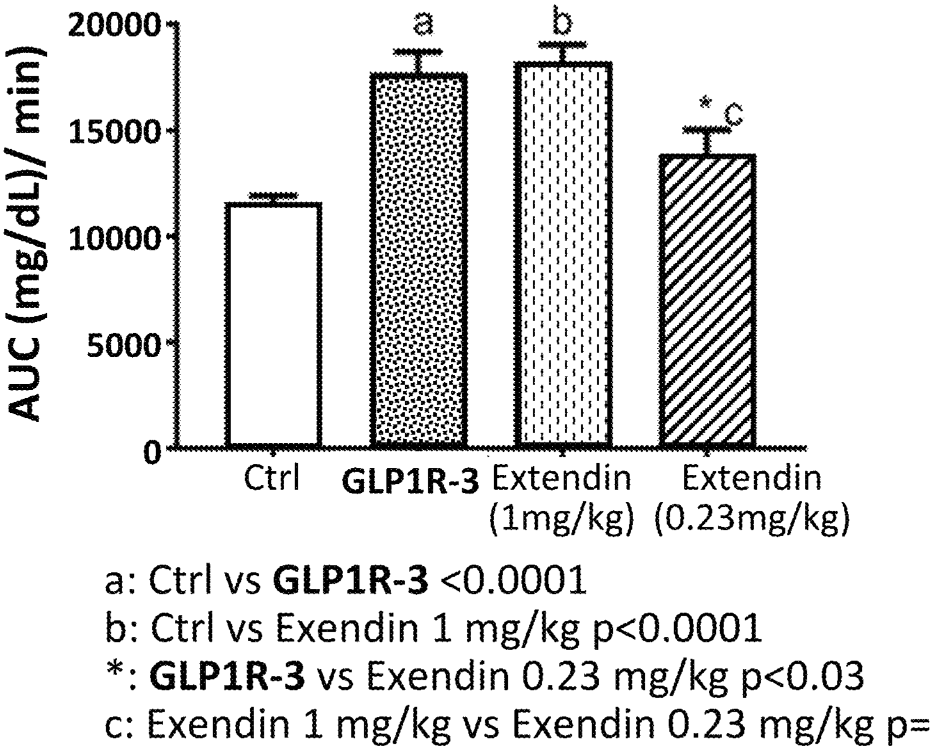
FIG. 21B depicts a graph of Area Under the Curve (AUC) in an insulin tolerance test (ITT).

Antagonist, GLP1R-3 mAb and GLP-1 peptide Exendin 9-39 treatment, with 19+2 hours dosing regimen before insulin challenge, significantly stabilizes a higher blood glucose in wild-type C57BL/6NHsd mice (FIG. 21A). Compared to control mice, GLP1R-3 mAb (20 mg/kg) and Exendin (1 mg/kg) treatments are both significant ($p<0.0001$) at stabilizing Area Under the Curve (AUC) in an ITT (FIG. 21B). However, there is no significant difference between GLP1R-3 and Control vs. Exendin (0.23 mg/kg) with 19+2 hour treatment.

Figure 22A:
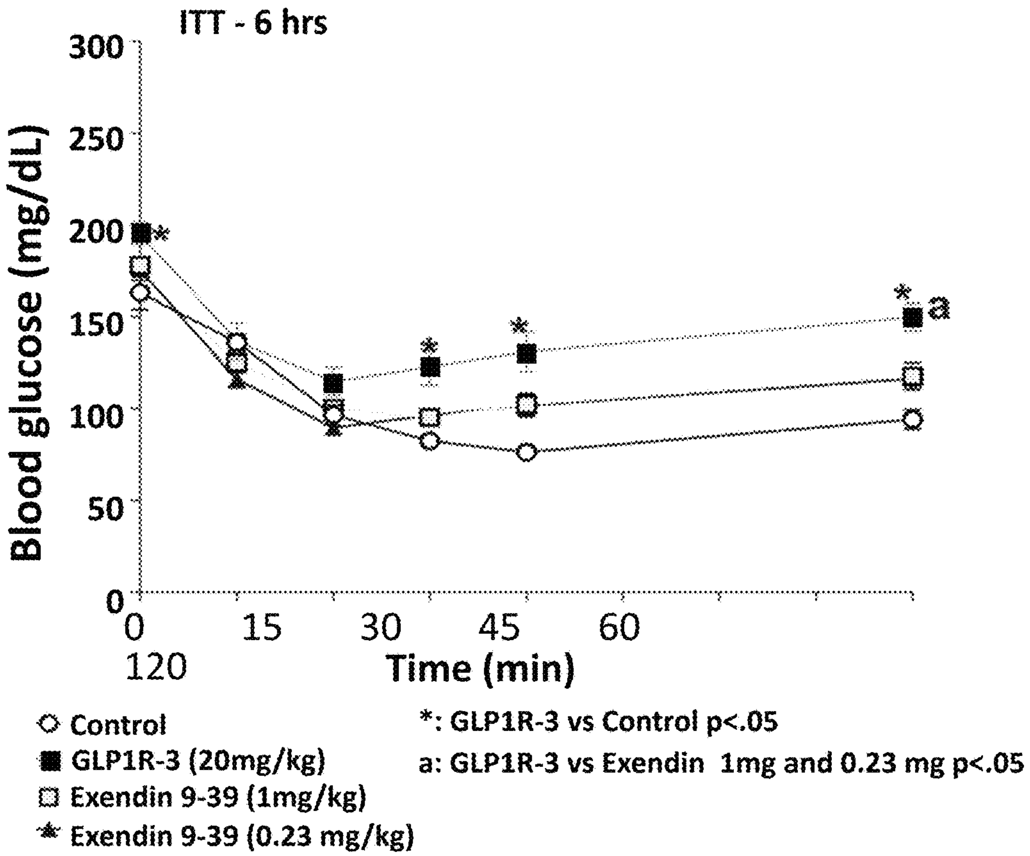
FIG. 22A depicts a graph of GLP1R-3 treatment, single 6 hour dosing regimen after insulin challenge, as compared to GLP-1 peptide Exendin 9-39 (1.0 or 0.23 mg/kg dose) or control.
Figure 22B:
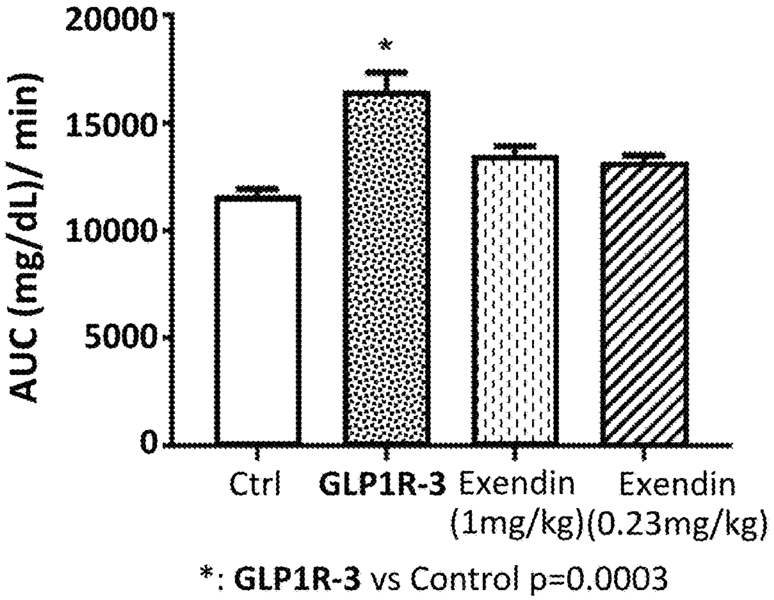
FIG. 22B depicts a graph of Area Under the Curve (AUC) of GLP1R-3 (20 mg/kg) treatment at 6 hours in an ITT.

Another experiment using a single 6 hour dosing regimen, antagonist, GLP1R-3 mAb treatment also significantly stabilizes a higher blood glucose after an insulin challenge compared to GLP-1 peptide Exendin 9-39 (1.0 or 0.23 mg/kg dose) or control (FIG. 22A). Compared to control mice, GLP1R-3 mAb (20 mg/kg) treatment at 6 hours significantly ($p<0.05$) stabilizes Area Under the Curve (AUC) in an ITT. However, there is no significant difference between Control vs. Exendin (1.0 and 0.23 mg/kg) with the single 6 hour treatment (FIG. 22B).

Figure 23A:
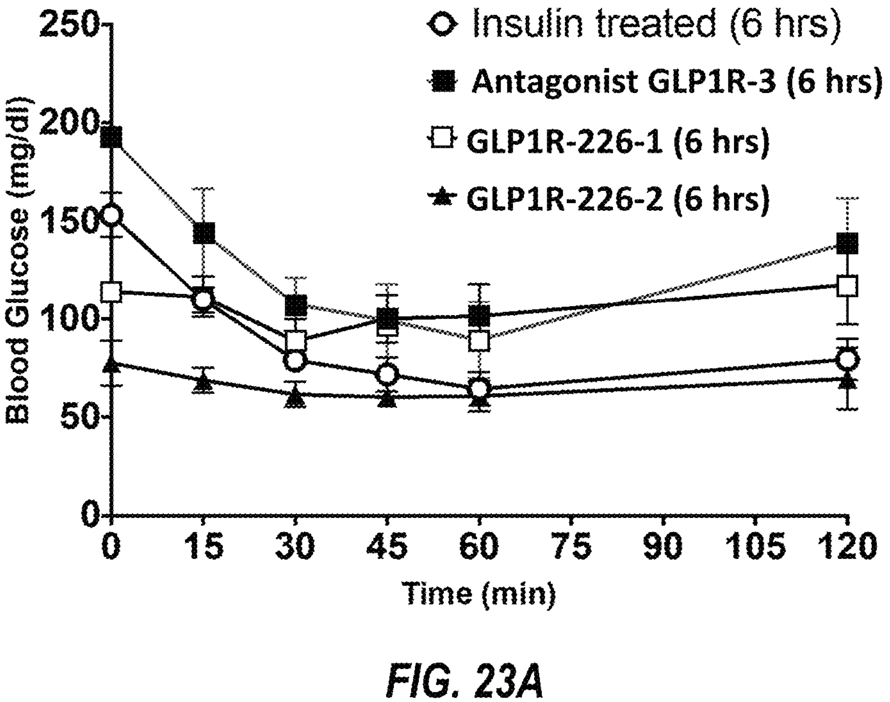
FIG. 23A depicts a graph of GLP1R-3 treatment, single 6 hour dosing regimen after insulin challenge, as compared to GLP1R-226-1, GLP1R-226-2, or control.
Figure 23B:
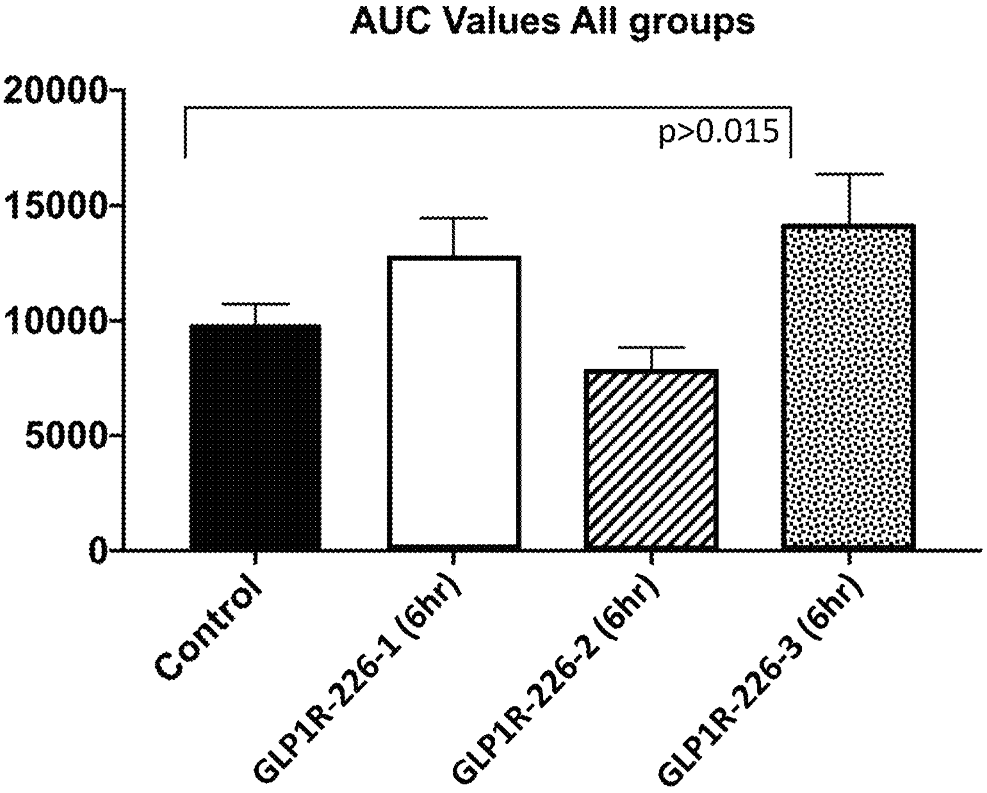
FIG. 23B depicts a graph Area Under the Curve (AUC) of GLP1R-3 treatment, single 6 hour dosing regimen after insulin challenge, as compared to GLP1R-226-1, GLP1R-226-2, or control.

GLP1R-3 mAb treatment was also compared to a comparator antibody GLP1R-226-1 and GLP1R-226-2. GLP1R-3 mAb treatment in a single 6 hour dosing regimen significantly stabilized a higher blood glucose after an insulin challenge (at time 0) compared to GLP1R-226-1 (20 mg/kg) or control (FIGS. 23A-23B). Compared to control mice, GLP1R-3 mAb (20 mg/kg) treatment at 6 hours, significantly ($p<0.05$) stabilized Area Under the Curve (AUC) in an ITT. There was no significant difference ($p<0.05$) between control vs. GLP1R-226-1 or GLP1R-226-2 with a single 6 hour treatment.

Example 5: GLP1R Variants

GLP1R-3 was optimized to generate additional GLP1R variants.

Figure 24A:
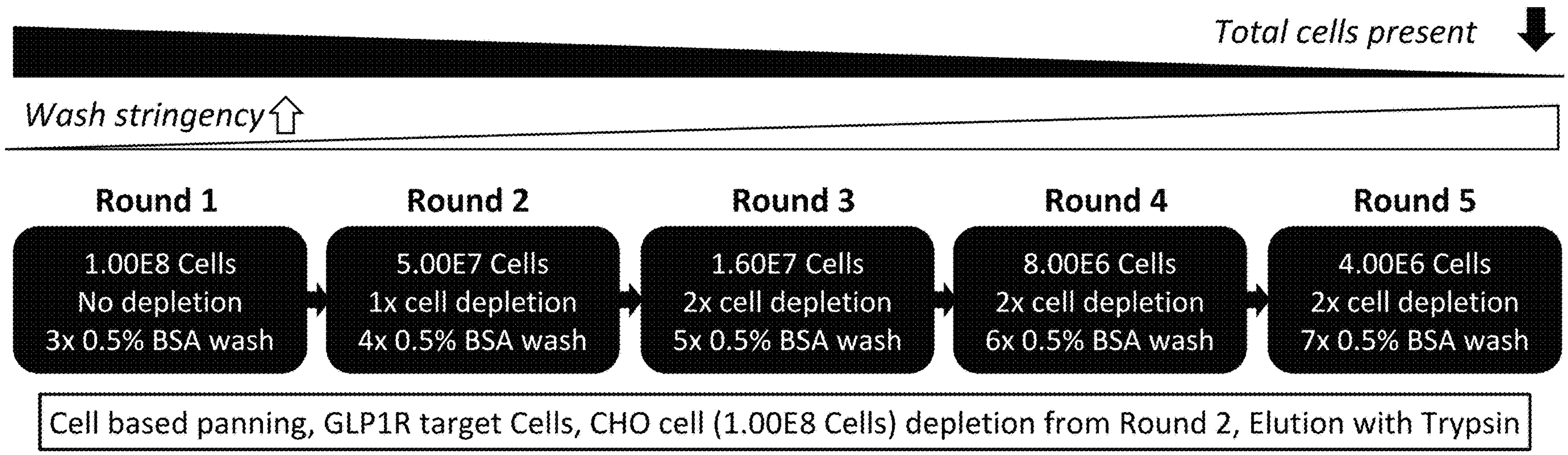
FIGS. 24A-24B are schemas of panning strategy for GLP1R-221 and GLP1R-222 variants.
Figure 24B:
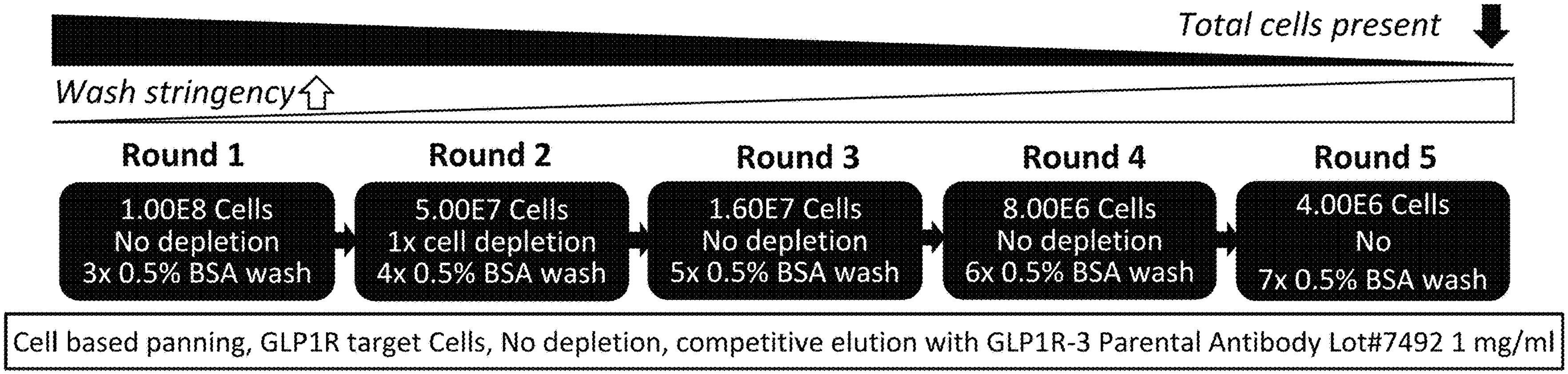

The panning strategy for GLP1R-221 and GLP1R-222 variants is seen in FIGS. 24A-24B. 768 clones from Round 4 and Round 5 were picked and sequenced on Miseq®. 95 unique clones were reformatted. Data for GLP1R-221 and GLP1R-222 variants is seen in Tables 6A-6H. Sequences for the GLP1R-221 and GLP1R-222 variants are seen in Tables 9-13.

TABLE 6A

| IgG | MFI Ratio | Subtraction |
|---|---|---|
| GLP1R-3 | 993.31197 | 232201 |
| GLP1R-221-065 | 914.54027 | 272235 |
| GLP1R-221-075 | 1174.8495 | 241813 |
| GLP1R-221-017 | 1484.8457 | 240383 |
| GLP1R-221-033 | 1015.9153 | 239520 |
| GLP1R-221-076 | 746.61867 | 235615.5 |
| GLP1R-221-092 | 711.73926 | 231701 |
| GLP1R-221-034 | 711.15764 | 222989.5 |
| GLP1R-221-066 | 927.53542 | 222368.5 |
| GLP1R-221-084 | 1067.8986 | 220848 |
| GLP1R-221-009 | 1119.868 | 220417 |

TABLE 6B

| IgG | MFI Ratio | Subtraction |
|---|---|---|
| GLP1R-3 | 740.2 | 223614 |
| GLP1R-222-052 | 13.70825851 | 350309.5 |
| GLP1R-222-016 | 773.9745223 | 242714 |
| GLP1R-222-023 | 777.8080645 | 240810.5 |
| GLP1R-222-014 | 794.2474916 | 237181 |
| GLP1R-222-090 | 525.349537 | 226519 |
| GLP1R-222-073 | 983.9519651 | 225096 |
| GLP1R-222-012 | 774.5748709 | 224723.5 |
| GLP1R-222-082 | 711.0952381 | 223680 |

TABLE 6B-continued

| IgG | MFI Ratio | Subtraction |
|---|---|---|
| GLP1R-222-081 | 850.1807692 | 220787 |
| GLP1R-222-056 | 946.2456522 | 217406.5 |

TABLE 6C

| Sample | Median RL1-H of Expressing Singlets | Median RL1-H of Parent Singlets | MFI Ratio |
|---|---|---|---|
| GLP1R221-017 | 240545 | 162 | 1484.8 |
| GLP1R221-075 | 242019 | 206 | 1174.8 |
| GLP1R221-009 | 220614 | 197 | 1119.9 |
| GLP1R221-084 | 221055 | 207 | 1067.9 |
| GLP1R221-044 | 217533.5 | 209 | 1040.8 |
| GLP1R221-033 | 239756 | 236 | 1015.9 |
| GLP1R01-3 | 232435 | 234 | 993.3 |
| GLP1R221-014 | 200638 | 203 | 988.4 |
| GLP1R221-083 | 212185 | 215 | 986.9 |
| GLP1R221-043 | 195703 | 201 | 973.6 |
| GLP1R221-082 | 195548 | 202 | 968.1 |
| GLP1R221-018 | 160183 | 167 | 959.2 |
| GLP1R221-001 | 200655 | 213 | 942.0 |
| GLP1R221-066 | 222608.5 | 240 | 927.5 |
| GLP1R221-065 | 272533 | 298 | 914.5 |
| GLP1R221-051 | 212862.5 | 234 | 909.7 |
| GLP1R221-003 | 203683.5 | 226 | 901.3 |
| GLP1R221-019 | 197108 | 224 | 879.9 |
| GLP1R221-088 | 197424 | 225.5 | 875.5 |
| GLP1R221-020 | 175621 | 205 | 856.7 |
| GLP1R221-021 | 163480.5 | 192 | 851.5 |
| GLP1R221-077 | 197424 | 236 | 836.5 |
| GLP1R221-069 | 191848 | 230 | 834.1 |
| GLP1R221-002 | 181529 | 219 | 828.9 |
| GLP1R221-040 | 208274 | 251.5 | 828.1 |
| GLP1R221-027 | 197258.5 | 241 | 818.5 |
| GLP1R221-094 | 203152 | 253 | 803.0 |
| GLP1R221-042 | 214005.5 | 268 | 798.5 |
| GLP1R221-022 | 199293 | 252 | 790.8 |
| GLP1R221-012 | 217522 | 283 | 768.6 |
| GLP1R221-031 | 168691 | 221 | 763.3 |
| GLP1R221-079 | 195512.5 | 257 | 760.7 |
| GLP1R221-059 | 194935.5 | 257 | 758.5 |
| GLP1R221-086 | 173390.5 | 229.5 | 755.5 |
| GLP1R221-076 | 235931.5 | 316 | 746.6 |
| GLP1R221-016 | 162165.5 | 220.5 | 735.4 |
| GLP1R221-054 | 163917 | 224 | 731.8 |
| GLP1R221-036 | 191269 | 264 | 724.5 |
| GLP1R221-072 | 218347 | 303 | 720.6 |
| GLP1R221-038 | 178492 | 248 | 719.7 |
| GLP1R221-092 | 232027 | 326 | 711.7 |
| GLP1R221-034 | 223303.5 | 314 | 711.2 |
| GLP1R221-058 | 168846 | 240 | 703.5 |
| GLP1R221-057 | 185403 | 268.5 | 690.5 |
| GLP1R221-090 | 183560 | 268 | 684.9 |
| GLP1R221-063 | 184038 | 274 | 671.7 |
| GLP1R221-029 | 197088 | 305 | 646.2 |
| GLP1R221-013 | 171640 | 266 | 645.3 |
| GLP1R221-030 | 160279 | 251 | 638.6 |
| GLP1R221-011 | 175641 | 283 | 620.6 |
| GLP1R221-060 | 178266.5 | 290 | 614.7 |
| GLP1R221-039 | 132161.5 | 219 | 603.5 |
| GLP1R221-015 | 176341.5 | 293 | 601.8 |
| GLP1R221-091 | 174624 | 295 | 591.9 |
| GLP1R221-074 | 173151 | 295.5 | 586.0 |
| GLP1R221-035 | 184526 | 315 | 585.8 |
| GLP1R221-041 | 101875 | 174 | 585.5 |
| GLP1R221-028 | 158490.5 | 271.5 | 583.8 |
| GLP1R221-046 | 137324.5 | 236 | 581.9 |
| GLP1R221-052 | 205979 | 370 | 556.7 |
| GLP1R221-073 | 102371 | 205 | 499.4 |
| GLP1R221-053 | 146049.5 | 301.5 | 484.4 |
| GLP1R221-056 | 197814 | 409 | 483.7 |

TABLE 6C-continued

| Sample | Median RL1-H of Expressing Singlets | Median RL1-H of Parent Singlets | MFI Ratio |
|---|---|---|---|
| GLP1R221-005 | 105542 | 226.5 | 466.0 |
| GLP1R221-087 | 178772 | 389 | 459.6 |
| GLP1R221-089 | 148048 | 325 | 455.5 |
| GLP1R221-071 | 138673 | 313 | 443.0 |
| GLP1R221-025 | 100871 | 233 | 432.9 |
| GLP1R221-032 | 172291 | 399 | 431.8 |
| GLP1R221-055 | 137657 | 329 | 418.4 |
| GLP1R221-010 | 107233 | 285 | 376.3 |
| GLP1R221-078 | 108233.5 | 301.5 | 359.0 |
| GLP1R221-024 | 79574 | 225 | 353.7 |
| GLP1R221-050 | 65939 | 204 | 323.2 |
| GLP1R221-008 | 74751.5 | 239 | 312.8 |
| GLP1R221-007 | 94850 | 358 | 264.9 |
| GLP1R221-062 | 59544 | 279 | 213.4 |
| GLP1R221-093 | 94190 | 444 | 212.1 |
| GLP1R221-068 | 56581 | 298 | 189.9 |
| GLP1R221-067 | 54810 | 300 | 182.7 |
| GLP1R221-085 | 201695 | 1352.5 | 149.1 |
| GLP1R221-064 | 42803 | 308 | 139.0 |
| GLP1R221-023 | 155330 | 1174 | 132.3 |
| GLP1R221-080 | 196473 | 1547 | 127.0 |
| GLP1R221-061 | 47559 | 482 | 98.7 |
| GLP1R221-070 | 21104.5 | 224 | 94.2 |
| GLP1R221-006 | 17593.5 | 286 | 61.5 |
| GLP1R221-045 | 603.5 | 174 | 3.5 |
| GLP1R221-004 | 519 | 164 | 3.2 |
| GLP1R221-047 | 397 | 167 | 2.4 |
| GLP1R221-048 | 214 | 142.5 | 1.5 |
| Stained Control | 145 | 142 | 1.0 |

TABLE 6D

| Sample | Median RL1-H of Expressing Singlets | Median RL1-H of Parent Singlets | MFI Ratio |
|---|---|---|---|
| GLP1R222-005 | 203990 | 173 | 1179.1 |
| GLP1R222-058 | 217592 | 186 | 1169.8 |
| GLP1R222-004 | 201104 | 189 | 1064.0 |
| GLP1R222-035 | 180903 | 172 | 1051.8 |
| GLP1R222-069 | 193190 | 187 | 1033.1 |
| GLP1R222-001 | 195159 | 193 | 1011.2 |
| GLP1R222-077 | 207327.5 | 208 | 996.8 |
| GLP1R222-072 | 196881.5 | 198.5 | 991.8 |
| GLP1R222-062 | 207390 | 209.5 | 989.9 |
| GLP1R222-073 | 225325 | 229 | 984.0 |
| GLP1R222-009 | 173411 | 176.5 | 982.5 |
| GLP1R222-064 | 207016 | 218 | 949.6 |
| GLP1R222-056 | 217636.5 | 230 | 946.2 |
| GLP1R222-089 | 196242 | 213 | 921.3 |
| GLP1R222-055 | 190727 | 209 | 912.6 |
| GLP1R222-046 | 204177 | 225.5 | 905.4 |
| GLP1R222-008 | 210228 | 234 | 898.4 |
| GLP1R222-078 | 176537.5 | 198 | 891.6 |
| GLP1R222-092 | 212558 | 240.5 | 883.8 |
| GLP1R222-007 | 211051 | 239 | 883.1 |
| GLP1R222-010 | 171471 | 195 | 879.3 |
| GLP1R222-081 | 221047 | 260 | 850.2 |
| GLP1R222-006 | 191343 | 227 | 842.9 |
| GLP1R222-066 | 189419 | 227 | 834.4 |
| GLP1R222-079 | 170284 | 206 | 826.6 |
| GLP1R222-042 | 214181 | 261 | 820.6 |
| GLP1R222-036 | 172934 | 214.5 | 806.2 |
| GLP1R222-014 | 237480 | 299 | 794.2 |
| GLP1R222-087 | 200143 | 252 | 794.2 |
| GLP1R222-086 | 181615.5 | 230 | 789.6 |
| GLP1R222-033 | 181334 | 230 | 788.4 |
| GLP1R222-074 | 205325 | 261 | 786.7 |
| GLP1R222-070 | 166040 | 212 | 783.2 |
| GLP1R222-002 | 192431 | 246 | 782.2 |
| GLP1R222-023 | 241120.5 | 310 | 777.8 |

TABLE 6D-continued

| Sample | Median RL1-H of Expressing Singlets | Median RL1-H of Parent Singlets | MFI Ratio |
|---|---|---|---|
| GLP1R222-012 | 225014 | 290.5 | 774.6 |
| GLP1R222-016 | 243028 | 314 | 774.0 |
| GLP1R222-063 | 214679.5 | 278 | 772.2 |
| GLP1R222-011 | 185538 | 242 | 766.7 |
| GLP1R222-028 | 182568 | 242 | 754.4 |
| GLP1R222-085 | 177368 | 239 | 742.1 |
| GLP1R01-3 | 223916.5 | 302.5 | 740.2 |
| GLP1R222-045 | 179811 | 246 | 730.9 |
| GLP1R222-054 | 153121 | 211 | 725.7 |
| GLP1R222-083 | 195648.5 | 274.5 | 712.7 |
| GLP1R222-082 | 223995 | 315 | 711.1 |
| GLP1R222-084 | 172287 | 247 | 697.5 |
| GLP1R222-076 | 186158 | 269 | 692.0 |
| GLP1R222-029 | 204757 | 300 | 682.5 |
| GLP1R222-060 | 113206.5 | 167 | 677.9 |
| GLP1R222-038 | 158998.5 | 236 | 673.7 |
| GLP1R222-026 | 154255.5 | 229 | 673.6 |
| GLP1R222-071 | 193867 | 288 | 673.1 |
| GLP1R222-053 | 131845 | 196 | 672.7 |
| GLP1R222-051 | 149756.5 | 224 | 668.6 |
| GLP1R222-093 | 152427 | 232 | 657.0 |
| GLP1R222-075 | 194948.5 | 297 | 656.4 |
| GLP1R222-065 | 184054.5 | 281 | 655.0 |
| GLP1R222-032 | 165221 | 255 | 647.9 |
| GLP1R222-059 | 142048 | 223 | 637.0 |
| GLP1R222-021 | 175543 | 278 | 631.4 |
| GLP1R222-025 | 134869 | 216 | 624.4 |
| GLP1R222-024 | 208523 | 345 | 604.4 |
| GLP1R222-022 | 200898 | 337 | 596.1 |
| GLP1R222-027 | 190430 | 326.5 | 583.2 |
| GLP1R222-015 | 187125 | 344.5 | 543.2 |
| GLP1R222-041 | 182770 | 344 | 531.3 |
| GLP1R222-090 | 226951 | 432 | 525.3 |
| GLP1R222-044 | 107845.5 | 208 | 518.5 |
| GLP1R222-040 | 167413.5 | 324 | 516.7 |
| GLP1R222-031 | 155641 | 331 | 470.2 |
| GLP1R222-088 | 170891 | 373 | 458.2 |
| GLP1R222-048 | 197618 | 441.5 | 447.6 |
| GLP1R222-018 | 126619 | 290 | 436.6 |
| GLP1R222-003 | 65950 | 155 | 425.5 |
| GLP1R222-080 | 96756.5 | 228 | 424.4 |
| GLP1R222-057 | 83288.5 | 204 | 408.3 |
| GLP1R222-047 | 118739 | 307 | 386.8 |
| GLP1R222-030 | 162896 | 506 | 321.9 |
| GLP1R222-091 | 56735.5 | 192 | 295.5 |
| GLP1R222-043 | 70814 | 406 | 174.4 |
| GLP1R222-037 | 58889 | 388 | 151.8 |
| GLP1R222-094 | 23462.5 | 176 | 133.3 |
| GLP1R222-068 | 135253 | 1167.5 | 115.8 |
| GLP1R222-019 | 39294 | 350 | 112.3 |
| GLP1R222-067 | 146186 | 1452 | 100.7 |
| GLP1R222-020 | 112537 | 1189 | 94.6 |
| GLP1R222-049 | 178616.5 | 2138.5 | 83.5 |
| GLP1R222-052 | 377875 | 27565.5 | 13.7 |
| Stained Control | 127 | 121 | 1.0 |

TABLE 6E

| Sample | GLP1 R221-009 | GLP1 R221-017 | GLP1 R221-033 | GLP1 R221-034 | GLP1 R221-065 | GLP1 R221-066 | GLP1 R221-075 | GLP1 R221-076 | GLP1 R221-084 | GLP1 R221-092 | GLP1 R01-3 |
|---|---|---|---|---|---|---|---|---|---|---|---|
| $EC_{50}$ [nM] CHO GLPIR | 12.46 | 27.65 | 9.041 | ND | ND | 57.39 | ND | ND | 4.091 | 13.29 | 11.51 |
| $B_{max}$ CHO GLPIR | 215146 | 249646 | 167203 | 932518 | 797529 | 171812 | 213495 | 799149 | 286814 | 144511 | 799671 |
| $EC_{50}$ [nM] CHO Parent | ND | ND | ND | ND | ND | ND | ND | ND | ND | ND | ND |
| $B_{max}$ CHO Parent | 267.4 | 228.7 | 146 | 279.8 | 261.9 | 112.1 | 234 | 183.2 | 266.6 | 291.2 | 268 |

TABLE 6F

| Sample | GLP1 R222-012 | GLP1 R222-014 | GLP1 R222-016 | GLP1 R222-023 | GLP1 R222-052 | GLP1 R222-056 | GLP1 R222-073 | GLP1 R222-081 | GLP1 R222-082 | GLP1 R222-090 | GLP1 R01-3 |
|---|---|---|---|---|---|---|---|---|---|---|---|
| $EC_{50}$ [nM] CHO GLP1R | 23.14 | 34.29 | 7.709 | 18.35 | 17.36 | 77.43 | 13.07 | 22.51 | 11.49 | ND | 15.4 |
| $B_{max}$ CHO GLP1R | 233768 | 213081 | 129918 | 220325 | 228012 | 292619 | 150681 | 193955 | 134940 | 1078076 | 152782 |
| $EC_{50}$ [nM] CHO Parent | ND | ND | ND | 89.37 | ND | ND | ND | ND | ND | ND | ND |
| $B_{max}$ CHO Parent | 340.6 | 336.4 | 218.5 | 237.9 | 47529 | 237.5 | 228.4 | 243.4 | 305 | 413.4 | 265.3 |

TABLE 6G

| [IgG] nM | GLP1 R221-009 | GLP1 R221-017 | GLP1 R221-033 | GLP1 R221-034 | GLP1R 221-065 | GLP1R 221-066 | GLP1R 221-075 | GLP1R 221-076 | GLP1R 221-084 | GLP1R 221-092 | GLP1R 01-3 |
|---|---|---|---|---|---|---|---|---|---|---|---|
| 100.00 | 1635.4 | 1844.6 | 1596.5 | 1015.0 | 1157.8 | 1056.4 | 834.9 | 1499.3 | 910.9 | 960.9 | 1193.7 |
| 33.33 | 1322.9 | 1303.9 | 1211.3 | 593.5 | 799.1 | 698.8 | 507.9 | 597.8 | 666.7 | 1019.4 | 1531.0 |
| 11.11 | 1058.6 | 707.5 | 1012.5 | 332.2 | 368.9 | 229.7 | 416.1 | 372.2 | 412.4 | 447.3 | 689.3 |
| 3.70 | 448.3 | 424.8 | 385.6 | 209.0 | 280.0 | 171.2 | 242.0 | 293.6 | 344.2 | 297.4 | 425.2 |
| 1.23 | 176.6 | 181.4 | 175.6 | 87.7 | 140.1 | 91.4 | 119.1 | 121.3 | 153.3 | 141.2 | 166.6 |
| 0.41 | 95.2 | 94.7 | 89.7 | 48.9 | 80.0 | 46.5 | 54.7 | 51.8 | 63.5 | 54.9 | 77.4 |
| 0.14 | 37.7 | 36.2 | 39.3 | 19.7 | 31.0 | 20.4 | 23.8 | 22.3 | 24.6 | 19.6 | 28.6 |
| 0.05 | 16.8 | 14.8 | 17.4 | 8.8 | 14.9 | 9.6 | 9.3 | 8.8 | 9.4 | 8.7 | 12.3 |

TABLE 6H

| [IgG] nM | GLP1 R222-012 | GLP1 R222-014 | GLP1 R222-016 | GLP1 R222-023 | GLP1 R222-052 | GLP1 R222-056 | GLP1 R222-073 | GLP1 R222-081 | GLP1 R222-082 | GLP1 R222-090 | GLP1 R01-3 |
|---|---|---|---|---|---|---|---|---|---|---|---|
| 100.00 | 1281.5 | 952.5 | 1049.1 | 1804.8 | 8.0 | 1522.2 | 1264.2 | 1404.0 | 845.8 | 746.6 | 1047.7 |
| 33.33 | 916.5 | 913.2 | 1412.1 | 1277.6 | 19.8 | 815.1 | 1057.9 | 1181.5 | 1027.4 | 526.8 | 1040.9 |
| 11.11 | 626.0 | 432.9 | 743.0 | 699.7 | 57.9 | 421.2 | 680.4 | 528.8 | 567.7 | 336.3 | 567.3 |
| 3.70 | 300.5 | 190.8 | 335.9 | 300.6 | 37.6 | 193.8 | 296.5 | 244.0 | 233.4 | 165.8 | 265.1 |
| 1.23 | 144.0 | 85.2 | 154.9 | 140.3 | 43.8 | 79.0 | 115.5 | 99.2 | 125.3 | 70.6 | 124.6 |
| 0.41 | 67.4 | 45.3 | 75.9 | 55.8 | 28.7 | 32.8 | 55.6 | 50.4 | 53.5 | 31.6 | 66.6 |
| 0.14 | 26.1 | 17.3 | 28.1 | 26.4 | 14.5 | 13.2 | 20.5 | 16.5 | 15.8 | 8.8 | 22.9 |
| 0.05 | 12.3 | 7.2 | 14.2 | 11.4 | 7.3 | 6.4 | 9.2 | 7.9 | 8.1 | 4.4 | 10.1 |

Figure 25A:
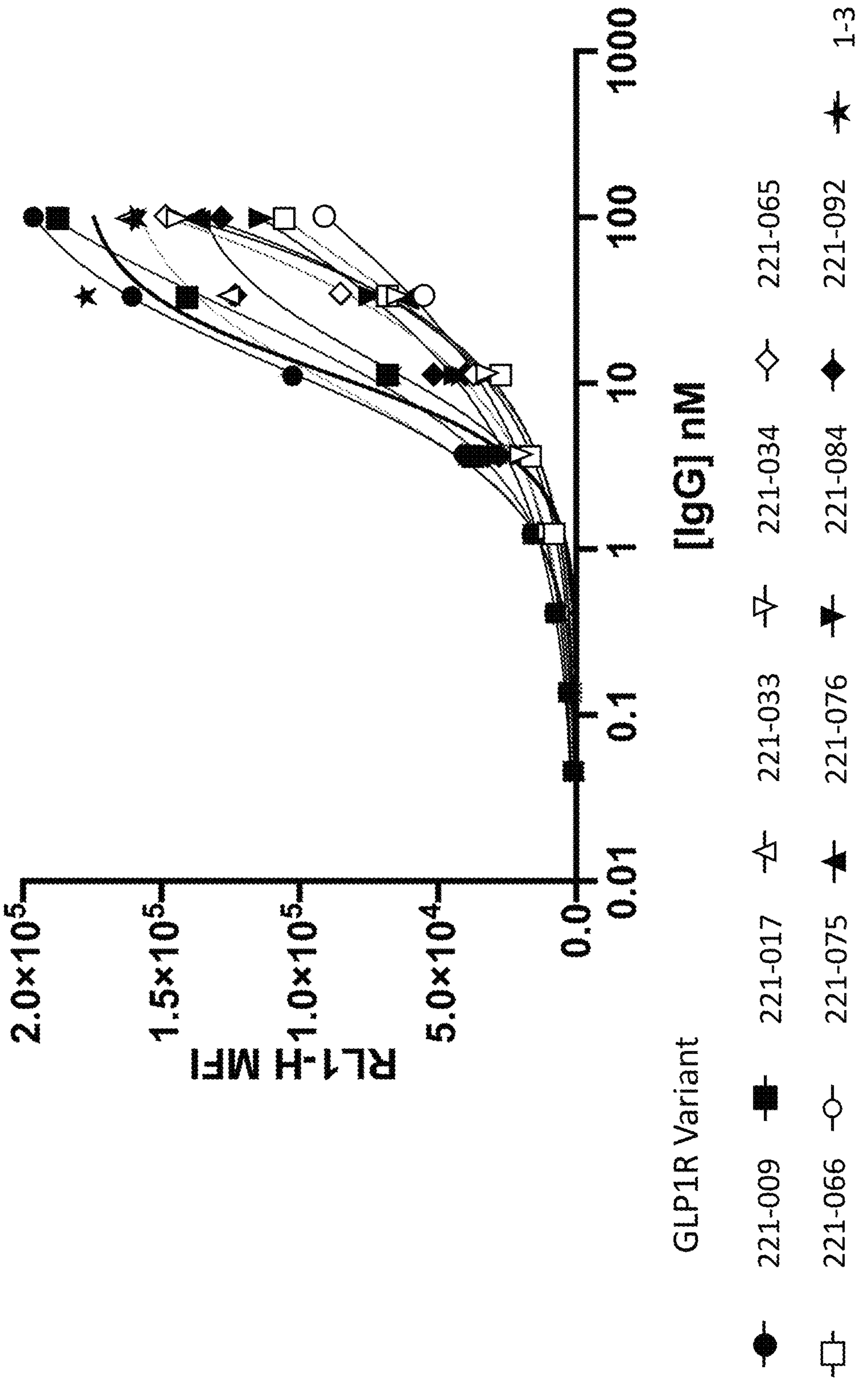
FIGS. 25A-25B are graphs of competition data for GLP1R-221 and GLP1R-222 variants.
Figure 25B:
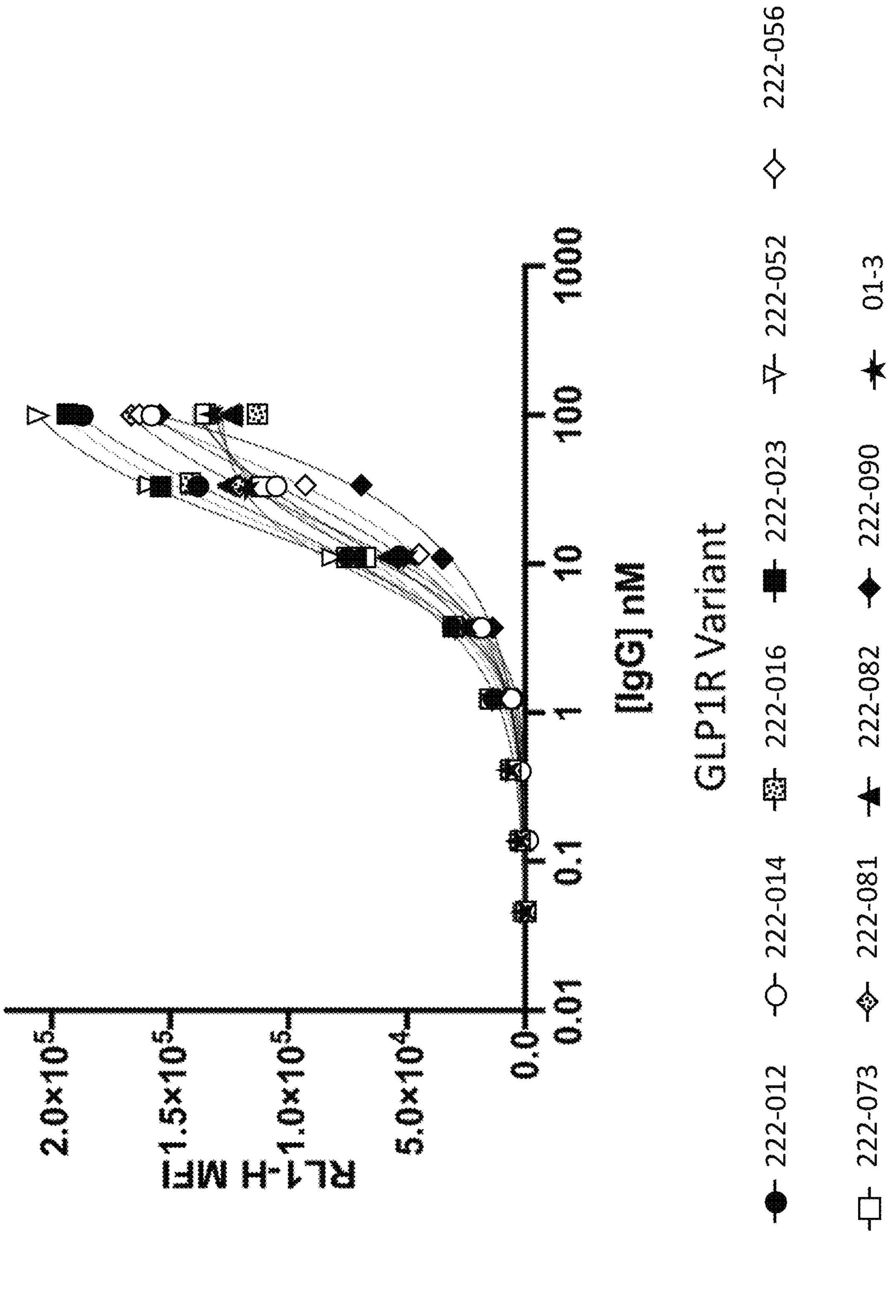
Figure 26:
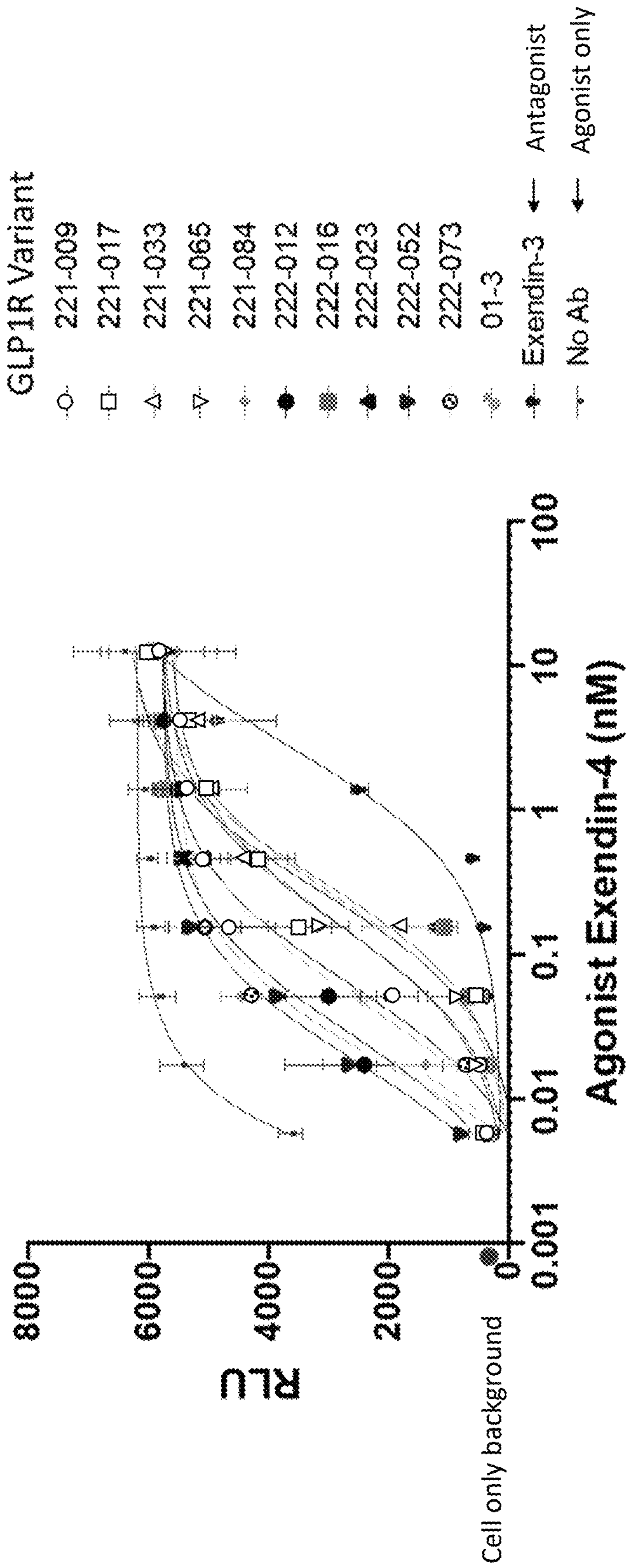
FIG. 26 is a graph of GLP1R-221 and GLP1R-222 variants in a CAMP assay.

The GLP1R-221 and GLP1R-222 variants were assayed in competition assays. Data is seen in FIGS. 25A-25B. The variants were also assayed in a cAMP assay. Briefly, cells were pre-incubated with anti-GLP1R antibody at 100 nM followed by agonist stimulation 3× titration from 12.5 nM. Data is seen in FIG. 26 with improved variants highlighted in green.

Example 6: Sequences

TABLE 7

Sequences of GLP1 embedded in CDRH3

| SEQ ID NO | Sequence |
|---|---|
| 1 | CAKHMSMQEGAVTGEGQAAKEFIAWLVKGRVRADLVGDAFDVW |
| 2 | CARDGRGSLPRPKGGPQTVGEGQAAKEFIAWLVKGGLTYDSSEDSG-GAFDIW |
| 3 | CAKHMSMQDYLVIGEGQAAKEFIAWLVKGGPARADLVGDAFDVW |
| 4 | CAKHMSMQEGAVTGEGQDAKEFIAWLVKGRVRADLVGDAFDVW |
| 5 | WAKHMSMQEGAVTGEGQAAKEFIAWLVKGRVRADLVGDAFDVW |
| 6 | CARDGRGSLPRPKGGPQTVGEGQAAKEFIAWLVKGRVRADLVGDAFDVW |
| 7 | CARANQHFYEQEGTFTSDVSSYLEGQAAKEFIAWLVKGGIRGYHYYGMDVW |
| 8 | CARANQHFTELHGEGQAAKEFIAWLVKGRGQIDIGYHYYGMDVW |
| 9 | CARANQHFLGAGVSSYLEGQAAKEFIAWLVKGDTTGYHYYGMDVW |
| 10 | CARANQHFLDKGTFTSDVSSYLEGQAAKEFIAWLVKGIYPGYHYYGMDVW |
| 11 | CARANQHFGTLSAGEGQAAKEFIAWLVKGGSQYDSSEDSGGAFDIW |
| 12 | CARANQHFGLHAQGEGQAAKEFIAWLVKGSGTYGYHYYGMDVW |
| 13 | CARANQHFGGKGEGQAAKEFIAWLVKGGGSGAGYHYYGMDVW |
| 14 | CAKQMSMQEGAVTGEGQAAKEFIAWLVKGRVRADLVGDAFDVW |
| 15 | CAKHMSMQEGAVTGEGQAAKEFIAWLVKGGPARADLVGDAFDVW |
| 16 | CAKHMSMQEGAVTGEGQAAKEFIAWLVKGGLTYDSSEDSGGAFDIW |
| 17 | CAKHMSMQDYLVIGEGQAAKEFIAWLVKGRVRADLVGDAFDVW |

TABLE 8

GLP1R Variants CDRH3 Sequences

| Variant | SEQ ID NO. | Sequence |
|---|---|---|
| GLP1R-1 | 18 | CARANQHFVDLYGWHGVPKGYHYYGMDVW |
| GLP1R-2 | 19 | CARDMYYDFETVVEGIQWYEALKAGKLGEVVPADDAFDIW |
| GLP1R-3 | 20 | CAKHMSMQEGAVTG**EGQAAKEFIAWLVKGRVR**ADLVGDAFDVW |
| GLP1R-8 | 21 | CARDGRGSLPRPKGGPQTVG**EGQAAKEFIAWLVKG**GLTYDSSEDSGGAFDIW |
| GLP1R-10 | 22 | CARANQHFFVPGSLKVWLKGVAPESSSEYDSSEDSGGAFDIW |
| GLP1R-25 | 23 | CARANQHFLSHAG**AARDFINWL**IQTKITGLGSGYHYYGMDVW |
| GLP1R-26 | 24 | CAKHMSMQEGVLQGQIPSTIDWEGLLHLIRADLVGDAFDVW |
| GLP1R-30 | 25 | CARDMYYDFLKIGDNL**AARDFINWL**IQTKITDGTDTEVVPADDAFDIW |
| GLP1R-50 | 26 | CARDGRGSLPRPKGGPKFVPGKHETYGHKTGYRLRPGYHYYGMDVW |
| GLP1R-56 | 27 | CARANQHFFSGA**EGEGQAAKEFIAWLVKG**IIPGYHYYGMDVW |

TABLE 8-continued

GLP1R Variants CDRH3 Sequences

| Variant | SEQ ID NO. | Sequence |
|---|---|---|
| GLP1R-58 | 28 | CARANQHFGLHAQG**EGQAAKEFIAWLVKG**SGTYGYHYYGMDVW |
| GLP1R-60 | 29 | CAKHMSMQDYLVIG**EGQAAKEFIAWLVKG**GPARADLVGDAFDVW |
| GLP1R-70 | 30 | CARDGRGSLPRPKGGPPSSG**RDFINWLIQTKIT**DGFRYDSSEDSGGAFDIW |
| GLP1R-71 | 31 | CARDLRELECEEWTRHGGKKHHGKRQSNRAHQGKHETYGHKTGSLVPSRGPCVDPRGVAGSFDVW |
| GLP1R-72 | 32 | CARDMYYDFHPEGTFTSDVSSYL**EGQAAKEFIAWLVKG**SLIYEVVPADDAFDIW |
| GLP1R-80 | 33 | CARANQHFGPVAGGATPSEEPGSQLTRAELGWDAPPGQESLADELLQLGTEHGYHYYGMDVW |
| GLP1R-83 | 34 | CAKHMSMQEGAVTG**EGQAAKEFIAWLVKG**RVRADLVGDAFDVW |
| GLP1R-93 | 35 | CARANQHFLSHAG**AARDFINWLIQTKIT**GLGSGYHYYGMDVW |
| GLP1R-98 | 36 | CARDGRGSLPRPKGGPHSGRLGSGYKSYDSSEDSGGAFDIW |
| GLP1R-238 | 37 | CARANQHFSQAGRAARVPGPSSSLGPRGYHYYGMDVW |
| GLP1R-239 | 38 | CAKHMSMQSQG**LDNLAARDFINWLIQTKITD**GFELSRADLVGDAFDVW |
| GLP1R-240 | 39 | CARDMYYDFFGL**GTFTSDVSSYLEGQAAKEFIAWLVKG**VSPEVVPADDAFDIW |
| GLP1R-241 | 40 | CAKHMSMQGSVAG**GTFTSDVSSYLEGQAAKEFIAWLVKG**GPSFIRADLVGDAFDVW |
| GLP1R-242 | 41 | CAKHMSMQADT**GTFTSDVSSYLEGQAAKEFIAWLVKG**EFSSRADLVGDAFDVW |
| GLP1R-243 | 42 | CARANQHFFGKG**DNLAARDFINWLIQTKITD**GSNPGYHYYGMDVW |
| GLP1R-244 | 43 | CARANQHFAATGAGE**GQAAKEFIAWLVKGR**VEIGYHYYGMDVW |

*bold corresponds to GLP1 or GLP2 motif

TABLE 9

Variable Heavy Chain Sequences

| Variant | SEQ ID NO. | Variable Heavy Chain Sequence |
|---|---|---|
| GLP1R-238 | 44 | MEWSWVFLFFLSVTTGVHSQVQLVQSGAEVKKPGSSVKVSCKASGGSFSSHAISWVRQAPGQGLEWMGGIIPIFGAPNYAQKFQGRVTITADESTSTAYMELSSLRSEDTAVYYCARANQHFSQAGRAARVPGPSSSLGPRGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| GLP1R-239 | 45 | MEWSWVFLFFLSVTTGVHSQVQLVESGGGVVQPGRSLRLSCAASGFDFSNYGMHWVRQAPGKGLEWVADISYEGSNKYYADSVKGRFTISRDNSKNTLYLQMNSLRAEDTAVYYCAKHMSMQSQGLDNLAARDFINWLIQTKITDGFELSRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |

TABLE 9-continued

Variable Heavy Chain Sequences

| Variant | SEQ ID NO. | Variable Heavy Chain Sequence |
|---|---|---|
| GLP1R-240 | 46 | MEWSWVFLFFLSVTTGVHSQVQLVQSGAEVKKPGSSVKVSCKASGGTENNYGISWVRQAPGQGLEWMGGIIPVFGTANYAQKFQGRVTITADESTSTAYMELSSLRSEDTAVYYCARDMYYDFFGLGTFTSDVSSYLEGQAAKEFIAWLVKGVSPEVVPADDAFDIWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| GLP1R-241 | 47 | MEWSWVFLFFLSVTTGVHSQVQLVQSGAEVKKPGSSVKVSCKASGGTFSDYAISWVRQAPGQGLEWMGGIIPIFGTTNYAQKFQGRVTITADESTSTAYMELSSLRSEDTAVYYCAKHMSMQGSVAGGTFTSDVSSYLEGQAAKEFIAWLVKGGPSFIRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| GLP1R-242 | 48 | MEWSWVFLFFLSVTTGVHSQVQLVQSGAEVKKPGSSVKVSCKASGGTFSSYEISWVRQAPGQGLEWMGGIIPILGIANYAQKFQGRVTITADESTSTAYMELSSLRSEDTAVYYCAKHMSMQADTGTFTSDVSSYLEGQAAKEFIAWLVKGEFSSRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| GLP1R-243 | 49 | MEWSWVFLFFLSVTTGVHSQVQLVQSGAEVKKPGSSVKVSCKASGGTFSTYGINWVRQAPGQGLEWMGGIIPIFGTANYAQKFQGRVTITADESTSTAYMELSSLRSEDTAVYYCARANQHFFGKGDNLAARDFINWLIQTKITDGSNPGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| GLP1R-244 | 50 | MEWSWVFLFFLSVTTGVHSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARANQHFAATGAGEGQAAKEFIAWLVKGRVEIGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| GLP1R-59-2 | 51 | QVQLVESGGGVVQPGRSLRLSCAASGFTFSNYGMSWVRQAPGKGLEWVAVISYDAGNKYYADSVKGRFTISRDNSKNTLYLQMNSLRAEDTAVYYCARDMYYDFETVVEGIQWYEALKAGKLGEVVPADDAFDIWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| GLP1R-59-241 | 52 | QVQLVQSGAEVKKPGSSVKVSCKASGGTFSDYAISWVRQAPGQGLEWMGGIIPIFGTTNYAQKFQGRVTITADESTSTAYMELSSLRSEDTAVYYCAKHMSMQGSVAGGTFTSDVSSYLEGQAAKEFIAWLVKGGPSFIRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |

TABLE 9-continued

Variable Heavy Chain Sequences

| Variant | SEQ ID NO. | Variable Heavy Chain Sequence |
|---|---|---|
| GLP1R-59-243 | 53 | QVQLVQSGAEVKKPGSSVKVSCKASGGTFSTYGINWVRQAPGQGLEWMGGIIPIFGTANYAQKFQGRVTITADESTSTAYMELSSLRSEDTAVYYCARANQHFFGKGDNLAARDFINWLIQTKITDGSNPGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG |
| GLP1R-3 | 54 | QVQLVESGGGVVQPGRSLRLSCAASGFTFSSYGMHWVRQAPGKGLEWVSFISYDESNKYYADSVKGRFTISRDNSKNTLYLQMNSLRAEDTAVYYCAKHMSMQEGAVTGEGQAAKEFIAWLVKGRVRADLVGDAFDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| GLP1R-43-8 | 55 | MEWSWVFLFFLSVTTGVHSEVQLVESGGGLVQAGGSLRLSCAASGSIFRINAMGWFRQAPGKEREGVAAINNFGTTKYADSAKGRFTISADNAKNTVYLQMNSLKPEDTAVYYCAAVRWGPHNDDRYDWGQGTQVTVSSGGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG |
| GLP1R-10 | 56 | QVQLVESGGGVVQPGRSLRLSCAASGFTFSNYDMHWVRQAPGKGLEWVAVISYEGSDKYYADSVKGRFTISRDNSKNTLYLQMNSLRAEDTAVYYCARANQHFFVPGSLKVWLKGVAPESSSEYDSSEDSGGAFDIWGQGTLVTVSS |
| GLP1R-26 | 57 | QVQLVQSGAEVKKPGSSVKVSCKASGGTRSNYAINWVRQAPGQGLEWMGGIIPILGTADYAQKFQGRVTITADESTSTAYMELSSLRSEDTAVYYCAKHMSMQEGVLQGQIPSTIDWEGLLHLIRADLVGDAFDVWGQGTLVTVSS |
| GLP1R-221-065 | 58 | QVQLVESGGGVVQPGRSLRLSCAASGFTFNNYAMHWVRQAPGKGLEWVAVISYDRSNEYYADSVKGRFTISRDNSKNTLYLQMNSLRAEDTAVYYCAKHMSMQEGAVTGDGQAAKEFIAWLVKGRVRADLVGDAFDVWGQGTLVTVSS |
| GLP1R-221-075 | 59 | QVQLVESGGGVVQPGRSLRLSCAASGFTFSNYPMHWVRQAPGKGLEWVAVISYDETNKYYADSVKGRFTISRDNSKNTLYLQMNSLRAEDTAVYYCAKHMSMQEGAVTGEGQAAKEFIAWLVKGIVRADLVGDAFDVWGQGTLVTVSS |
| GLP1R-221-017 | 60 | QVQLVESGGGVVQPGRSLRLSCAASGFTFSDYGVHWVRQAPGKGLEWVAFISYDESNKYYADSVKGRFTISRDNSKNTLYLQMNSLRAEDTAVYYCAKHMSMQEGAVTGEYQAAKEFIAWLVKGRVRADLVGDAFDVWGQGTLVTVSS |
| GLP1R-221-033 | 61 | QVQLVESGGGVVQPGRSLRLSCAASGFSFSNYAMHWVRQAPGKGLEWVAVISHDRSNKYYADSVKGRFTISRDNSKNTLYLQMNSLRAEDTAVYYCAKHMSMQEGAVTGEGQAAKDFIAWLVKGRVRADLVGDAFDVWGQGTLVTVSS |
| GLP1R-221-076 | 62 | QVQLVESGGGVVQPGRSLRLSCAASGFTFNNYPMHWVRQAPGKGLEWVAVISYDETNKYYADSVKGRFTISRDNSKNTLYLQMNSLRAEDTAVYYCAKHMSMQEGAVTGEGQAAKEFIAWLVKGIVRADLVGDAFDVWGQGTLVTVSS |
| GLP1R-221-092 | 63 | QVQLVESGGGVVQPGRSLRLSCAASGFIFNNYGMHWVRQAPGKGLEWVAFISYGGSNKYYADSVKGRFTISRDNSKNTLYLQMNSLRAEDTAVYYCAKHMSMQEGAVTGEGQAVKEFIAWLVKGRVRADLVGDAFDVWGQGTLVTVSS |
| GLP1R-221-034 | 64 | QVQLVESGGGVVQPGRSLRLSCAASGFPFSNYGMHWVRQAPGKGLEWVAVISHDRSNKYYADSVKGRFTISRDNSKNTLYLQMNSLRAEDTAVYYCAKHMSMQEGAVTGEGQAVKEFIAWLVKGRVRADLVGDAFDVWGQGTLVTVSS |
| GLP1R-221-066 | 65 | QVQLVESGGGVVQPGRSLRLSCAASGFTFNNYAMHWVRQAPGKGLEWVAVISYDRSNEYYADSVKGRFTISRDNSKNTLYLQMNSLRAEDTAVYYCAKHMSMQEGAVTGEGQAIKEFIAWLVKGRVRADLVGDAFDVWGQGTLVTVSS |
| GLP1R-221-084 | 66 | QVQLVESGGGVVQPGRSLRLSCAASGFAFSNYGMHWVRQAPGKGLEWVAVISSDENNKYYADSVKGRFTISRDNSKNTLYLQMNSLRAEDTAVYYCAKHMSMQEGAVTGEMQAAKEFIAWLVKGRVRADLVGDAFDVWGQGTLVTVSS |
| GLP1R-221-009 | 67 | QVQLVESGGGVVQPGRSLRLSCAASGFIFSNYGMHWVRQAPGKGLEWVAVISDEGSNKYYADSVKGRFTISRDNSKNTLYLQMNSLRAEDTAVYYCAKHMSMQEGAVTGAGQAAKEFIAWLVKGRVRADLVGDAFDVWGQGTLVTVSS |

TABLE 9-continued

| Variable Heavy Chain Sequences | | |
|---|---|---|
| Variant | SEQ ID NO. | Variable Heavy Chain Sequence |
| GLP1R-222-052 | 68 | QVQLVESGGGVVQPGRSLRLSCAASGFTFNNYPMHWVRQAPGKGLEWVAVISYDESNKYYADSVKGRFTISRDNSKNTLYLQMNSLRAEDTAVYYCAKHMSMQEGAVTGGGQAAKEFIAWLVKGRVRADLVGDAFDVWGQGTLVTVSS |
| GLP1R-222-016 | 69 | QVQLVESGGGVVQPGRSLRLSCAASGFTFNNYAMHWVRQAPGKGLEWVAVISDEGSNKYYADSVKGRFTISRDNSKNTLYLQMNSLRAEDTAVYYCAKHMSMQEGAVTGEYQAAKEFIAWLVKGRVRADLVGDAFDVWGQGTLVTVSS |
| GLP1R-222-023 | 70 | QVQLVESGGGVVQPGRSLRLSCAASGFSFSDYGMHWVRQAPGKGLEWVAFISYDANNKYYADSVKGRFTISRDNSKNTLYLQMNSLRAEDTAVYYCAKHMSMQEGAVTGEWQAAKEFIAWLVKGRVRADLVGDAFDVWGQGTLVTVSS |
| GLP1R-222-014 | 71 | QVQLVESGGGVVQPGRSLRLSCAASGFAFSNYGMHWVRQAPGKGLEWVSFISYDESNKYYADSVKGRFTISRDNSKNTLYLQMNNLRAEDTAVYYCAKHMSMQEGAVTGEWQAAKEFIAWLVKGRVRADLVGDAFDVWGQGTLVTVSS |
| GLP1R-222-090 | 72 | QVQLVESGGGVVQPGRSLRLSCAASGFSFSDYGIHWVRQAPGKGLEWVALISYEGSNKYYADSVKGRFTISRDNSKNTLYLQMNSLRAEDTAVYYCAKHMSMQEGAVTGEKQAAKEFIAWLVKGRVRADLVGDAFDVWGQGTLVTVSS |
| GLP1R-222-073 | 73 | QVQLVESGGGVVQPGRSLRLSCAASGFTFRDYGMHWVRQAPGKGLEWVAFIRYDEINKYYADSVKGRFTISRDNSKNTLYLQMNSLRAEDTAVYYCAKHMSMQEGAVTGEGQAAKEFIAWLVGGRVRADLVGDAFDVWGQGTLVTVSS |
| GLP1R-222-012 | 74 | QVQLVESGGGVVQPGRSLRLSCAASGFTFNNYGMHWVRQAPGKGLEWVAVISDEGSNKYYADSVKGRFTISRDNSKNTLYLQMNSLRAEDTAVYYCAKHMSMQEGAVTGVGQAAKEFIAWLVKGRVRADLVGDAFDVWGQGTLVTVSS |
| GLP1R-222-082 | 75 | QVQLVESGGGVVQPGRSLRLSCAASGFTFSAYSMHWVRQAPGKGLEWVALISYDATNKYYADSVKGRFTISRDNSKNTLYLQMNSLRAEDTAVYYCAKHMSMQEGAVTGEFQAAKEFIAWLVKGRVRADLVGDAFDVWGQGTLVTVSS |
| GLP1R-222-081 | 76 | QVQLVESGGGVVQPGRSLRLSCAASGFTFDNYALHWVRQAPGKGLEWVALISYDAGNKYYADSVKGRFTISRDNSKNTLYLQMNSLRAEDTAVYYCAKHMSMQEGAVTGEGQAAKEFIAWLVKGFVRADLVGDAFDVWGQGTLVTVSS |
| GLP1R-222-056 | 77 | QVQLVESGGGVVQPGRSLRLSCAASGFPFSSYAMHWVRQAPGKGLEWVAVISYDRSNKYYADSVKGRFTISRDNSKNTLYLQMNSLRAEDTAVYYCAKHMSMQEGAVTGYGQAAKEFIAWLVKGFVRADLVGDAFDVWGQGTLVTVSS |

TABLE 10

| Variable Light Chain Sequences | | |
|---|---|---|
| Variant | SEQ ID NO. | Variable Light Chain Sequence |
| GLP1R-238 | 78 | MSVPTQVLGLLLLWLTDARCQSVLTQPPSVSAAPGQKVTISCSGSTSNIANNYVSWYQQLPGTAPKLLIYANNRRPSGIPDRFSGSKSGTSATLGITGLQTGDEADYYCGAWDVRLDVGVFGGGTKLTVLGQPKAAPSVTLFPPSSEELQANKATLVCLISDFYPGAVTVAWKADSSPVKAGVETTTPSKQSNNKYAASSYLS |
| GLP1R-239 | 79 | MSVPTQVLGLLLLWLTDARCQSVLTQPPSVSAAPGQKVTISCSGSTSNIEKNYVSWYQQLPGTAPKLLIYGNDQRPSGIPDRFSGSKSGTSATLGITGLQTGDEADYYCGTWENRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| GLP1R-240 | 80 | MSVPTQVLGLLLLWLTDARCQSVLTQPPSVSAAPGQKVTISCSGSSSSIGNNYVSWYQQLPGTAPKLLIYANNKRPSGIPDRFSGSKSGTSATLGITGLQTGDEADYYCATWSSSPRGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| GLP1R-241 | 81 | MSVPTQVLGLLLLWLTDARCQSVLTQPPSVSAAPGQKVTISCSGISSNIGNNYVSWYQQLPGTAPKLLIYDDDQRPSGIPDRFSGSKSGTSATLGITGLQTGDEADYYCGTWDNILSAAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |

TABLE 10-continued

Variable Light Chain Sequences

| Variant | SEQ ID NO. | Variable Light Chain Sequence |
|---|---|---|
| GLP1R-242 | 82 | MSVPTQVLGLLLLWLTDARCQSVLTQPPSVSAAPGQKVTISCSGSSSNIENNDVSW YQQLPGTAPKLLIYGNDQRPSGIPDRFSGSKSGTSATLGITGLQTGDEADYYCGTW DNTLSAGVFGGGTKLTVLGQPKAAPSVTLFPPSSEELQANKATLVCLISDFYPGAV TVAWKADSSPVKAGVETTTPSKQSNNKYAASSYLSLTPEQWKSHRSYSCQVTHEG STVEKTVAPTECS |
| GLP1R-243 | 83 | MSVPTQVLGLLLLWLTDARCQSVLTQPPSVSAAPGQKVTISCSGSRSNIGKNYVSW YQQLPGTAPKLLIYENNERPSGIPDRFSGSKSGTSATLGITGLQTGDEADYYCSSYT TSNTQVFGGGTKLTVLGQPKAAPSVTLFPPSSEELQANKATLVCLISDFYPGAVTV AWKADSSPVKAGVETTTPSKQSNNKYAASSYLSLTPEQWKSHRSYSCQVTHEGST VEKTVAPTECS |
| GLP1R-244 | 84 | MSVPTQVLGLLLLWLTDARCQSVLTQPPSVSAAPGQKVTISCSGSSSNIGNNVVSW YQQLPGTAPKLLIYDNDKRRSGIPDRFSGSKSGTSATLGITGLQTGDEADYYCGSW DTSLSVWVFGGGTKLTVLGQPKAAPSVTLFPPSSEELQANKATLVCLISDFYPGAV TVAWKADSSPVKAGVETTTPSKQSNNKYAASSYLSLTPEQWKSHRSYSCQVTHEG STVEKTVAPTECS |
| GLP1R-59-243 | 85 | HAEGTFTSDVSSYLEGQAAKEFIAWLVKGRGGGGGSGGGGSGGGGSQSVLTQPPS VSAAPGQKVTISCSGSRSNIGKNYVSWYQQLPGTAPKLLIYENNERPSGIPDRFSGS KSGTSATLGITGLQTGDEADYYCSSYTTSNTQVFGGGTKLTVLGQPKAAPSVTLFP PSSEELQANKATLVCLISDFYPGAVTVAWKADSSPVKAGVETTTPSKQSNNKYAA SSYLSLTPEQWKSHRSYSCQVTHEGSTVEKTVAPTECS |
| GLP1R-59-241 | 86 | HAEGTFTSDVSSYLEGQAAKEFIAWLVKGRGGGGGSGGGGSGGGGSQSVLTQPPS VSAAPGQKVTISCSGISSNIGNNYVSWYQQLPGTAPKLLIYDDDQRPSGIPDRFSGS KSGTSATLGITGLQTGDEADYYCGTWDNILSAAVFGGGTKLTVLGQPKAAPSVTL FPPSSEELQANKATLVCLISDFYPGAVTVAWKADSSPVKAGVETTTPSKQSNNKYA ASSYLSLTPEQWKSHRSYSCQVTHEGSTVEKTVAPTECS |
| GLP1R-59-2 | 87 | HGEGTFTSDVSSYLEEQAAKEFIAWLVKGGGGGGGSGGGGSGGGGSQSALTQPAS VSGSPGQSITISCTGTSNDIGTYNYVSWYQQHPGKAPKLMIYDVSGRPSGVSNRFS GSKSGNTASLTISGLQAEDEADYYCSSYTTSSTEVFGGGTKLTVLGQPKAAPSVTL FPPSSEELQANKATLVCLISDFYPGAVTVAWKADSSPVKAGVETTTPSKQSNNKYA ASSYLSLTPEQWKSHRSYSCQVTHEGSTVEKTVAPTECS |
| GLP1R-59-2A | 88 | HAEGTFTSDVSSYLEGQAAKEFIAWLVKGRGGGGGSGGGGSGGGGSQSALTQPAS VSGSPGQSITISCTGTSNDIGTYNYVSWYQQHPGKAPKLMIYDVSGRPSGVSNRFS GSKSGNTASLTISGLQAEDEADYYCSSYTTSSTEVFGGGTKLTVLGQPKAAPSVTL FPPSSEELQANKATLVCLISDFYPGAVTVAWKADSSPVKAGVETTTPSKQSNNKYA ASSYLSLTPEQWKSHRSYSCQVTHEGSTVEKTVAPTECS |
| GLP1R-3 | 89 | QSVLTQPPSVSAAPGQKVTISCSGSSSNIADNYVSWYQQLPGTAPKLLIYDNNKRPS GIPDRFSGSKSGTSATLGITGLQTGDEADYYCGTWDNYLGAGVFGGGTKLTVLGQ PKAAPSVTLFPPSSEELQANKATLVCLISDFYPGAVTVAWKADSSPVKAGVETTTP SKQSNNKYAASSYLSLTPEQWKSHRSYSCQVTHEGSTVEKTVAPTECS |
| GLP1R-10 | 90 | EIVMTQSPATLSVSPGERATLSCRASHSVSSDLAWYQQKPGQAPRLLIYSASSRAT GIPARFSGSGSGTEFTLTISSLQSEDFAVYYCQQYNNWPPASTFGGGTKVEIK |
| GLP1R-26 | 91 | EIVMTQSPATLSVSPGERATLSCSASQSVSTKLAWYQQKPGQAPRLLIYGASTRAK GIPARFSGSGSGTEFTLTISLQSEDFAVYYCQHYHNWPLTFGGGTKVEIK |
| GLP1R-221-065 | 92 | QSVLTQPPSVSAAPGQKVTISCSGTTSNIANNFVSWYQQLPGTAPKLLIYDHNKRPS GIPDRFSGSKSGTSATLGITGLQTGDEADYYCGTWDTSLSAGAFGGGTKLTVL |
| GLP1R-221-075 | 93 | QSVLTQPPSVSAAPGQKVTISCSGSGSNIGNNDVSWYQQLPGTAPKLLIYDNDKRP AGIPDRFSGSKSGTSATLGITGLQTGDEADYYCGTWDTSLSNYVFGGGTKLTVL |
| GLP1R-221-017 | 94 | QSVLTQPPSVSAAPGQKVTISCSGSSSNIGNTYVSWYQQLPGTAPKLLIYDDYKRPS GIPDRFSGSKSGTSATLGITGLQTGDEADYYCATWDATLNTGVFGGGTKLTVL |
| GLP1R-221-033 | 95 | QSVLTQPPSVSAAPGQKVTISCSGSSSNIGNEYVSWYQQLPGTAPKLLIYDNNKRV SGIPDRFSGSKSGTSATLGITGLQTGDEADYYCATWDTSLNVGVFGGGTKLTVL |
| GLP1R-221-076 | 96 | QSVLTQPPSVSAAPGQKVTISCSGTSSNIGNNDVSWYQQLPGTAPKLLIYENNKRH SGIPDRFSGSKSGTSATLGITGLQTGDEADYYCLTWDHSLTAYVFGGGTKLTVL |
| GLP1R-221-092 | 97 | QSVLTQPPSVSAAPGQKVTISCSGTTSNIANNFVSWYQQLPGTAPKLLIYDNNKRPP GIPDRFSGSKSGTSATLGITGLQTGDEADYYCGTWDTSLSVGMFGGGTKLTVL |
| GLP1R-221-034 | 98 | QSVLTQPPSVSAAPGQKVTISCSGSSSNIGNNPVSWYQQLPGTAPKLLIYENDNRPS GIPDRFSGSKSGTSATLGITGLQTGDEADYYCATWDRGLSTGVFGGGTKLTVL |

TABLE 10-continued

| Variable Light Chain Sequences | | |
|---|---|---|
| Variant | SEQ ID NO. | Variable Light Chain Sequence |
| GLP1R-221-066 | 99 | QSVLTQPPSVSAAPGQKVTISCSGSSSNIGNNYLSWYQQLPGTAPKLLIYENNKRPS GIPDRFSGSKSGTSATLGITGLQTGDEADYYCGIWDRSLSAWVFGGGTKLTVL |
| GLP1R-221-084 | 100 | QSVLTQPPSVSAAPGQKVTISCSGSSSNIADNYVSWYQQLPGTAPKLLIYENNRRPS GIPDRFSGSKSGTSATLGITGLQTGDEADYYCGTWDVSLSVGMFGGGTKLTVL |
| GLP1R-221-009 | 101 | QSVLTQPPSVSAAPGQKVTISCSGSSSNIGNQYVSWYQQLPGTAPKLLIYDDHKRPS GIPDRFSGSKSGTSATLGITGLQTGDEADYYCGTWDTSLSVGEFGGGTKLTVL |
| GLP1R-222-052 | 102 | QSVLTQPPSVSAAPGQKVTISCSGSSSNIGKRSVSWYQQLPGTAPKLLIYDNNKRAS GIPDRFSGSKSGTSATLGITGLQTGDEADYYCVTWDRSLSAGVFGGGTKLTVL |
| GLP1R-222-016 | 103 | QSVLTQPPSVSAAPGQKVTISCSGSSSNIENNDVSWYQQLPGTAPKLLIYDFNKRPS GIPDRFSGSKSGTSATLGITGLQTGDEADYYCGTWDTSLSVGMFGGGTKLTVL |
| GLP1R-222-023 | 104 | QSVLTQPPSVSAAPGQKVTISCSGSSSNIGNNDVSWYQQLPGTAPKLLIYENTKRPS GIPDRFSGSKSGTSATLGITGLQTGDEADYYCGTWDAGLSTGVFGGGTKLTVL |
| GLP1R-222-014 | 105 | QSVLTQPPSVSAAPGQKVTISCSGSSSNIGNHDVSWYQQLPGTAPKLLIYDNNKRH SGIPDRFSGSKSGTSATLGITGLQTGDEADYYCGTWDTSLSAGVFGGGTKLTVL |
| GLP1R-222-090 | 106 | QSVLTQPPSVSAAPGQKVTISCSGSSSNIADNYVSWYQQLPGTAPKLLIYDNNKRA SGIPDRFSGSKSGTSATLGITGLQTGDEADYYCATWDNRLSAGVFGGGTKLTVL |
| GLP1R-222-073 | 107 | QSVLTQPPSVSAAPGQKVTISCSGSGSNIGNNDVSWYQQLPGTAPKLLIYDNNKRA SGIPDRFSGSKSGTSATLGITGLQTGDEADYYCGTWDRGPNTGVFGGGTKLTVL |
| GLP1R-222-012 | 108 | QSVLTQPPSVSAAPGQKVTISCSGSSSNIGNNDVSWYQQLPGTAPKLLIYDDDKRPS GIPDRFSGSKSGTSATLGITGLQTGDEADYYCGTWDTSLSVGEFGGGTKLTVL |
| GLP1R-222-082 | 109 | QSVLTQPPSVSAAPGQKVTISCSGSSSNIGSKYVSWYQQLPGTAPKLLIYDNNKRPS GIPDRFSGSKSGTSATLGITGLQTGDEADYYCGTWDISPSAWVFGGGTKLTVL |
| GLP1R-222-081 | 110 | QSVLTQPPSVSAAPGQKVTISCSGSSSNIGSDYVSWYQQLPGTAPKLLIYDNNKRSS GIPDRFSGSKSGTSATLGITGLQTGDEADYYCGTWDESLRSWVFGGGTKLTVL |
| GLP1R-222-056 | 111 | QSVLTQPPSVSAAPGQKVTISCSGSSSNIGSNYISWYQQLPGTAPKLLIYDNDKRPA GIPDRFSGSKSGTSATLGITGLQTGDEADYYCGTWDTSLSVGEFGGGTKLTVL |

TABLE 11

| GLP1R Sequences | | |
|---|---|---|
| GLP1R Variant | SEQ ID NO | Sequence |
| GLP1R-40-01 | 112 | EVQLVESGGGLVQPGGSLRLSCAASGFTCGDYTMGWFRQAPGKEREFLAAITSG GATTYDDNRKSRFTISADNSKNTAYLQMNSLKPEDTAVYYCWAALDGYGGRW GQGTLVTVSS |
| GLP1R-40-02 | 113 | EVQLVESGGGLVQPGGSLRLSCAASGRTFRINRMGWFRQAPGKEREWVSTICSR GDTYYADSVKGRFTISADNSKNTAYLQMNSLKPEDTAVYYCAATLDGYSGSWG QGTLVTVSS |
| GLP1R-40-03 | 114 | EVQLVESGGGLVQPGGSLRLSCAASGRDFRVKNMGWFRQAPGKEREFVARITW NGGSAYYADSVKGRFTISADNSKNTAYLQMNSLKPEDTAVYYCAARILSRNWG QGTLVTVSS |
| GLP1R-40-04 | 115 | EVQLVESGGGLVQPGGSLRLSCAASGFTFSFYTMGWFRQAPGKEREFVAAISSGG RTSYADSVKGRFTISADNSKNTAYLQMNSLKPEDTAVYYCAAALDGYEGSWGQ GTLVTVSS |
| GLP1R-40-05 | 116 | EVQLVESGGGLVQPGGSLRLSCAASGFTFSFYAMGWFRQAPGKEREFVAAISSGG RTRYADNVKGRFTISADNSKNTAYLQMNSLKPEDTAVYYCSAALDGYNGIWGQ GTLVTVSS |
| GLP1R-40-06 | 117 | EVQLVESGGGLVQPGGSLRLSCAASGHTSDTYIMGWFRQAPGKEREFVSLINWSS GKTIYADSVKGRFTISADNSKNTAYLQMNSLKPEDTAVYYCAKGDYRGGYYYP QTSQWGQGTLVTVSS |

TABLE 11-continued

GLP1R Sequences

| GLP1R Variant | SEQ ID NO | Sequence |
|---|---|---|
| GLP1R-40-07 | 118 | EVQLVESGGGLVQPGGSLRLSCAASGFTFSSYPMGWFRQAPGKEREFVATIPSGG STYYADSVKGRFTISADNSKNTAYLQMNSLKPEDTAVYYCAAALDGYNGSWGQ GTLVTVSS |
| GLP1R-40-08 | 119 | EVQLVESGGGLVQPGGSLRLSCAASGFTFGEFTMGWFRQAPGKERERVATITSGG STNYADSVKGRFTISADNSKNTAYLQMNSLKPEDTAVYYCAAVVDDYSGSWGQ GTLVTVSS |
| GLP1R-40-09 | 120 | EVQLVESGGGLVQPGGSLRLSCAASGFTDGIDAMGWFRQAPGKEREVVAGIAW GDGITYYADSVKGRFTISADNSKNTAYLQMNSLKPEDTAVYYCAASYNVYYNN WGQGTLVTVSS |
| GLP1R-40-10 | 121 | EVQLVESGGGLVQPGGSLRLSCAASGRTFSSGVMGWFRQAPGKEREFVAAINRS GSTFYADSVKGRFTISADNSKNTAYLQMNSLKPEDTAVYYCAKTKRTGIFTTAR MVDWGQGTLVTVSS |
| GLP1R-40-11 | 122 | EVQLVESGGGLVQPGGSLRLSCAASGVTLDDYAMGWFRQAPGKEREFVAAINRS GSITYYADSVKGRFTISADNSKNTAYLQMNSLKPEDTAVYYCAAYYTDYDEALE ETRGSYDWGQGTLVTVSS |
| GLP1R-40-12 | 123 | EVQLVESGGGLVQPGGSLRLSCAASGLTFGIYAMGWFRQAPGKEREFVATISRSG ASTYYADSVKGRFTISADNSKNTAYLQMNSLKPEDTAVYYCAAIVTYNDYDRGH DWGQGTLVTVSS |
| GLP1R-40-13 | 124 | EVQLVESGGGLVQPGGSLRLSCAASGFTFSSDGMGWFRQAPGKERELVAAINRS GSTFYADSVKGRFTISADNSKNTAYLQMNSLKPEDTAVYYCAKTARPGIFTTAPV EDWGQGTLVTVSS |
| GLP1R-40-14 | 125 | EVQLVESGGGLVQPGGSLRLSCAASGFTCGNYTMGWFRQAPGKERESVASITSG GRTNYADSVKGRFTISADNSKNTAYLQMNSLKPEDTAVYYCAATLDGYTGSWG QGTLVTVSS |
| GLP1R-40-15 | 126 | EVQLVESGGGLVQPGGSLRLSCAASGFTFNYYPMGWFRQAPGKEREWVATISRG GGTYYADNVKGRFTISADNSKNTAYLQMNSLKPEDTAVYYCSAALDGYSGIWG QGTLVTVSS |
| GLP1R-40-16 | 127 | EVQLVESGGGLVQPGGSLRLSCAASGIIGSFRTMGWFRQAPGKEREFVGFITGSG GTTYYADSVKGRFTISADNSKNTAYLQMNSLKPEDTAVYYCAAARRYGNLYNT NNYDWGQGTLVTVSS |
| GLP1R-40-17 | 128 | EVQLVESGGGLVQPGGSLRLSCAASGITFRFKAMGWFRQAPGKEREFVAAISWR GGSTNYADSVKGRFTISADNSKNTAYLQMNSLKPEDTAVYYCAAATLGEPLVKY TWGQGTLVTVSS |
| GLP1R-40-18 | 129 | EVQLVESGGGLVQPGGSLRLSCAASGSFFSINAMGWFRQAPGKEREFVAGISSKG GSSTYYADSVKGRFTISADNSKNTAYLQMNSLKPEDTAVYYCAAHRIVVGGTSV GDWRWGQGTLVTVSS |
| GLP1R-40-19 | 130 | EVQLVESGGGLVQPGGSLRLSCAASGSRFSGRFNILNMGWFRQAPGKEREFVAAI SRSGDTTYYADSVKGRFTISADNSKNTAYLQMNSLKPEDTAVYYCAASLRNSGS NVEGRWGQGTLVTVSS |
| GLP1R-40-20 | 131 | EVQLVESGGGLVQPGGSLRLSCAASGGTSNSYRMGWFRQAPGKEREFVAVISWT GGSTYYADSVKGRFTISADNSKNTAYLQMNSLKPEDTAVYYCAVALDGYSGSW GQGTLVTVSS |
| GLP1R-40-21 | 132 | EVQLVESGGGLVQPGGSLRLSCAASGFNIGTYTMGWFRQAPGKEREFVAAIGSN GLANYADNVKGRFTISADNSKNTAYLQMNSLKPEDTAVYYCSAALDGYSGTWG QGTLVTVSS |
| GLP1R-40-22 | 133 | EVQLVESGGGLVQPGGSLRLSCAASGRTFSVYAMGWFRQAPGKEREFVAGIHSD GSTLYADSVKGRFTISADNSKNTAYLQMNSLKPEDTAVYYCAAVLDGYMGTWG QGTLVTVSS |
| GLP1R-40-23 | 134 | EVQLVESGGGLVQPGGSLRLSCAASGNIKSIDVMGWFRQAPGKERELVAAVRWS GGITWYADSVKGRFTISADNSKNTAYLQMNSLKPEDTAVYYCAAVVYYGDWEG SEPVQHEYDWGQGTLVTVSS |
| GLP1R-40-24 | 135 | EVQLVESGGGLVQPGGSLRLSCAASGFTFSNYAMGWFRQAPGKEREFVAAIYCS DGSTQYADSVKGRFTISADNSKNTAYLQMNSLKPEDTAVYYCAEALDGYWGQG TLVTVSS |
| GLP1R-40-25 | 136 | EVQLVESGGGLVQPGGSLRLSCAASGYTFRAYAMGWFRQAPGKEREMVAAMR WSGGITWYADSVKGRFTISADNSKNTAYLQMNSLKPEDTAVYYCAAQGSLYDD YDGLPIKYDWGQGTLVTVSS |

TABLE 11-continued

| GLP1R Sequences | | |
|---|---|---|
| GLP1R Variant | SEQ ID NO | Sequence |
| GLP1R-40-26 | 137 | EVQLVESGGGLVQPGGSLRLSCAASGLTFSSYAMGWFRQAPGKERECVTAIFSDGGTYYADNVKGRFTISADNSKNTAYLQMNSLKPEDTAVYYCAAALDGYNGYWGQGTLVTVSS |
| GLP1R-40-27 | 138 | EVQLVESGGGLVQPGGSLRLSCAASGIHFAISTMGWFRQAPGKEREIVTAINWSGARTYYADSVKGRFTISADNSKNTAYLQMNSLKPEDTAVYYCAAKFVNTDSTWSRSEMYTWGQGTLVTVSS |
| GLP1R-40-28 | 139 | EVQLVESGGGLVQPGGSLRLSCAASGLTFTSYAMGWFRQAPGKEREGVAVIDSDGTTYYADSVKGRFTISADNSKNTAYLQMNSLKPEDTAVYYCAAYLDGYSGSWGQGTLVTVSS |
| GLP1R-40-29 | 140 | EVQLVESGGGLVQPGGSLRLSCAASGRTFSSLPMGWFRQAPGKERELVAIRWSGGSTVYADSVKGRFTISADNSKNTAYLQMNSLKPEDTAVYYCAAIAYEEGVYRWGQGTLVTVSS |
| GLP1R-40-30 | 141 | EVQLVESGGGLVQPGGSLRLSCAASGRTFSSGVMGWFRQAPGKEREFVAAINRSGSTFYADSVKGRFTISADNSKNTAYLQMNSLKPEDTAVYYCAKTKRTGIFTTWGQGTLVTVSS |
| GLP1R-40-31 | 142 | EVQLVESGGGLVQPGGSLRLSCAASGFTFSSYAMGWFRQAPGKERELVAAISSGGSTSYADSVKGRFTISADNSKNTAYLQMNSLKPEDTAVYYCAAAMDGYSGSWGQGTLVTVSS |
| GLP1R-40-32 | 143 | EVQLVESGGGLVQPGGSLRLSCAASGFTDGIDAMGWFRQAPGKEREYVAAISGSGSITNYADSVKGRFTISADNSKNTAYLQMNSLKPEDTAVYYCAANGIESYGWGNRHFNWGQGTLVTVSS |
| GLP1R-40-33 | 144 | EVQLVESGGGLVQPGGSLRLSCAASGFTDGIDAMGWFRQAPGKEREFVAAIRWSGGITWYADSVKGRFTISADNSKNTAYLQMNSLKPEDTAVYYCAAAIFDVTDYERADWGQGTLVTVSS |
| GLP1R-40-34 | 145 | EVQLVESGGGLVQPGGSLRLSCAASGFAFSGYAMGWFRQAPGKEREFVAAISWSGGITWYADSVKGRFTISADNSKNTAYLQMNSLKPEDTAVYYCAFVTTNSDYDLGRDWGQGTLVTVSS |
| GLP1R-40-35 | 146 | EVQLVESGGGLVQPGGSLRLSCAASGIPASIRTMGWFRQAPGKEREGVSWISSSDGSIYYADSVKGRFTISADNSKNTAYLQMNSLKPEDTAVYYCVAALDGYSGSWGQGTLVTVSS |
| GLP1R-40-36 | 147 | EVQLVESGGGLVQPGGSLRLSCAASGRTFSSLPMGWFRQAPGKERELVAIRWSGGSTVYADSVKGRFTISADNSKNTAYLQMNSLKPEDTAVYYCAAIAYEEGVYRWDWGQGTLVTVSS |
| GLP1R-40-37 | 148 | EVQLVESGGGLVQPGGSLRLSCAASGFNSGSYTMGWFRQAPGKEREGVSWISTTDGSTYYADSVKGRFTISADNSKNTAYLQMNSLKPEDTAVYYCAAALDGYSGIWGQGTLVTVSS |
| GLP1R-40-38 | 149 | EVQLVESGGGLVQPGGSLRLSCAASGFTFSVYAMGWFRQAPGKEREFVTAIDSESRTLYADSVKGRFTISADNSKNTAYLQMNSLKPEDTAVYYCAALLDGYLGTWGQGTLVTVSS |
| GLP1R-40-39 | 150 | EVQLVESGGGLVQPGGSLRLSCAASGSVFKINVMGWFRQAPGKEREFLGSILWSDDSTNYADSVKGRFTISADNSKNTAYLQMNSLKPEDTAVYYCAANLKQGSYGYRFNDWGQGTLVTVSS |
| GLP1R-40-40 | 151 | EVQLVESGGGLVQPGGSLRLSCAASGTIVNIHVMGWFRQAPGKERELVAAITSGGSTSYADNVKGRFTISADNSKNTAYLQMNSLKPEDTAVYYCAASAIGSGALRHFEYDWGQGTLVTVSS |
| GLP1R-40-41 | 152 | EVQLVESGGGLVQPGGSLRLSCAASGRSLGTYHMGWFRQAPGKEREGVSWISSSDGSTYYADSVKGRFTISADNSKNTAYLQMNSLKPEDTAVYYCAVVLDGYSGSWGQGTLVTVSS |
| GLP1R-40-42 | 153 | EVQLVESGGGLVQPGGSLRLSCAASGFTFDDTGMGWFRQAPGKEREFVAAIRWSGKETWYADSVKGRFTISADNSKNTAYLQMNSLKPEDTAVYYCAAEDPSMYYTLEEYEYDWGQGTLVTVSS |
| GLP1R-40-43 | 154 | EVQLVESGGGLVQPGGSLRLSCAASGFTFSSYVMGWFRQAPGKERECVAAISSSDGRTYYADSVKGRFTISADNSKNTAYLQMNSLKPEDTAVYYCAAALDGYSGNWGQGTLVTVSS |

TABLE 11-continued

GLP1R Sequences

| GLP1R Variant | SEQ ID NO | Sequence |
|---|---|---|
| GLP1R-40-44 | 155 | EVQLVESGGGLVQPGGSLRLSCAASGSIFRVNVMGWFRQAPGKEREFIATIFSGGDTDYADSVKGRFTISADNSKNTAYLQMNSLKPEDTAVYYCAAIAHEEGVYRWDWGQGTLVTVSS |
| GLP1R-40-45 | 156 | EVQLVESGGGLVQPGGSLRLSCAASGFTCGDYTMGWFRQAPGKEREIVASITSGGRKNYADSVKGRFTISADNSKNTAYLQMNSLKPEDTAVYYCAAALDDYSGSWGQGTLVTVSS |
| GLP1R-40-46 | 157 | EVQLVESGGGLVQPGGSLRLSCAASGHSFGNFPMGWFRQAPGKEREVIAAIDWSGGSTFYADSVKGRFTISADNSKNTAYLQMNSLKPEDTAVYYCAAAKGIGVYGWGQGTLVTVSS |
| GLP1R-40-47 | 158 | EVQLVESGGGLVQPGGSLRLSCAASGSSFRFRAMGWFRQAPGKEREFVAAINRGGKISHYADSVKGRFTISADNSKNTAYLQMNSLKPEDTAVYYCAAYIRPDTYLSRDYRKYDWGQGTLVTVSS |
| GLP1R-40-48 | 159 | EVQLVESGGGLVQPGGSLRLSCAASGFTWGDYTMGWFRQAPGKEREGVAAIDSDGRTRYADSVKGRFTISADNSKNTAYLQMNSLKPEDTAVYYCAAALDGYSGSWGQGTLVTVSS |
| GLP1R-40-49 | 160 | EVQLVESGGGLVQPGGSLRLSCAASGNILSLNTMGWFRQAPGKEREFVAGISWSGGSTYYADSVKGRFTISADNSKNTAYLQMNSLKPEDTAVYYCAAIVTYSDYDLGNDWGQGTLVTVSS |
| GLP1R-40-50 | 161 | EVQLVESGGGLVQPGGSLRLSCAASGITFRRYDMGWFRQAPGKEREGVAYISSSDGSTYYADSVKGRFTISADNSKNTAYLQMNSLKPEDTAVYYCAAVLDDYSGGWGQGTLVTVSS |
| GLP1R-40-51 | 162 | EVQLVESGGGLVQPGGSLRLSCAASGLTLSNYAMGWFRQAPGKEREFVAAISRSGSSTYYADSVKGRFTISADNSKNTAYLQMNSLKPEDTAVYYCAAEMSGISGWDWGQGTLVTVSS |
| GLP1R-40-52 | 163 | EVQLVESGGGLVQPGGSLRLSCAASGYTTSINTMGWFRQAPGKEREVVAAISRTGGSTYYADSVKGRFTISADNSKNTAYLQMNSLKPEDTAVYYCAASAIGSGALRRFEYDWGQGTLVTVSS |
| GLP1R-40-53 | 164 | EVQLVESGGGLVQPGGSLRLSCAASGRTFSIDAMGWFRQAPGKEREFVAAIKPDGSITYYADSVKGRFTISADNSKNTAYLQMNSLKPEDTAVYYCAASASDYGLGLELFHDEYNWGQGTLVTVSS |
| GLP1R-40-54 | 165 | EVQLVESGGGLVQPGGSLRLSCAASGSIFSLNAMGWFRQAPGKERELVAGISSKGGSTYYADSVKGRFTISADNSKNTAYLQMNSLKPEDTAVYYCAAFRGIMRPDWGQGTLVTVSS |
| GLP1R-40-55 | 166 | EVQLVESGGGLVQPGGSLRLSCAASGFTFSSYRMGWFRQAPGKEREAVAAIASMGGLTYYADSVKGRFTISADNSKNTAYLQMNSLKPEDTAVYYCAAALDGYIGSWGQGTLVTVSS |
| GLP1R-40-56 | 167 | EVQLVESGGGLVQPGGSLRLSCAASGFTFGAFTMGWFRQAPGKERERVAAITCSGSTTYADSVKGRFTISADNSKNTAYLQMNSLKPEDTAVYYCSAALDGYNGSWGQGTLVTVSS |
| GLP1R-40-57 | 168 | EVQLVESGGGLVQPGGSLRLSCAASGIPSTIRAMGWFRQAPGKERESVGRIYWRDDNTYYADSVKGRFTISADNSKNTAYLQMNSLKPEDTAVYYCAAVLDGYSGSWGQGTLVTVSS |
| GLP1R-40-58 | 169 | EVQLVESGGGLVQPGGSLRLSCAASGFTDGIDAMGWFRQAPGKEREVVAGIAWGDGITYYADSVKGRFTISADNSKNTAYLQMNSLKPEDTAVYYCAASYNVYYNNYYYPISRDEYDWGQGTLVTVSS |
| GLP1R-43-1 | 170 | EVQLVESGGGLVQAGGSLRLSCAASGRTIVPYTMGWFRQAPGKEREVVASISWSGKSTYYADSVRGRFTISADNAKNTVYLQMNSLKPEDTAVYYCAAQRRWSQDWGQGTQVTVSS |
| GLP1R-43-2 | 171 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPTGRGERDYWGQGTQVTVSS |
| GLP1R-43-3 | 172 | EVQLVESGGGLVQAGGSLRLSCAASGFTFSNYAMGWFRQAPGKEREFVATITWSGSSTYYADSVKGRFTISADNAKNTVYLQMNSLKPEDTAVYYCAAVPRLYREYGYWGQGTQVTVSS |
| GLP1R-43-4 | 173 | EVQLVESGGGLVQAGGSLRLSCAASGSIFHINPMGWFRQAPGKEREfVAAINIFGTTNYADSVKGRFTISADNAKNTVYLQMNSLKPEDTAVYYCAAVDGGPLWDDGYDWGQGTQVTVSS |

TABLE 11-continued

GLP1R Sequences

| GLP1R Variant | SEQ ID NO | Sequence |
|---|---|---|
| GLP1R-43-5 | 174 | EVQLVESGGGLVQAGGSLRLSCAASGSIFRINAMGWFRQAPGKEREGVASINIFGTTKYADSVKGRFTISADNAKNTVYLQMNSLKPEDTAVYYCSAVGWGPHNDDRYDWGQGTQVTVSS |
| GLP1R-43-6 | 175 | EVQLVESGGGLVQAGGSLRLSCAASGTTFSIYAMEWFRQAPGKERELVATISRSGGTTYYADSVGGRFTISADNAKNTVYLQMNSLKPEDTAVYYCAAASWYYRDDYWGQGTQVTVSS |
| GLP1R-43-7 | 176 | EVQLVESGGGLVQAGGSLRLSCAASGSIFRINAMGWFRQAPGKEREGVAAINNFGTTKYADSVKGRFTISADNAKNTVYLQMNSLKPEDTAVYYCSAVRWGPHNDDRYDWGQGTQVTVSS |
| GLP1R-43-8 | 177 | EVQLVESGGGLVQAGGSLRLSCAASGSIFRINAMGWFRQAPGKEREGVAAINNFGTTKYADSAKGRFTISADNAKNTVYLQMNSLKPEDTAVYYCAAVRWGPHNDDRYDWGQGTQVTVSS |
| GLP1R-43-9 | 178 | EVQLVESGGGLVQAGGSLRLSCAASGFILYGYAMGWFRQAPGKEREGVSSISPSDASTYYADSVKGRFTISADNAKNTVYLQMNSLKPEDTAVYYCAAVLNTYSDSWGQGTQVTVSS |
| GLP1R-43-10 | 179 | EVQLVESGGGLVQAGGSLRLSCAASGRTFSSYAMGWFRQAPGKEREGVTAISTSDGSTYYADSVKGRFTISADNAKNTVYLQMNSLKPEDTAVYYCAAARDGYSGSWGQGTQVTVSS |
| GLP1R-43-11 | 180 | EVQLVESGGGLVQAGGSLRLSCAASGYTITNSYRMGWFRQAPGKEREFVAGITMSGFNTRYADSVKGRFTISADNAKNTVYLQMNSLKPEDTAVYYCAANRGLAGPAWGQGTQVTVSS |
| GLP1R-43-12 | 181 | EVQLVESGGGLVQAGGSLRLSCAASGFTFDDNAMGWFRQAPGKEREFVSGISTSGSTTYYADSVKGRFTISADNAKNTVYLQMNSLKPEDTAVYYCAAAAGGYDYWGQGTQVTVSS |
| GLP1R-43-13 | 182 | EVQLVESGGGLVQAGGSLRLSCAASGRTFSYYHMGWFRQAPGKEREGVSWISSYYSSTYYADSESGRFTISADNAKNTVYLQMNSLKPEDTAVYYCAAVLDGYSCSWGQGTQVTVSS |
| GLP1R-43-14 | 183 | EVQLVESGGGLVQAGGSLRLSCAASGSPFRLYTMGWFRQAPGKEREVVAHIYSYGSINYADSVKGRFTISADNAKNTVYLQMNSLKPEDTAVYYCAAALWGHSGDWGQGTQVTVSS |
| GLP1R-43-15 | 184 | EVQLVESGGGLVQAGGSLRLSCAASGSTFDTYGMGWFRQAPGKEREFVASITWSGSSTYYADSVKGRFTISADNAKNTVYLQMNSLKPEDTAVYYCAANRIHWSGFYYWGQGTQVTVSS |
| GLP1R-43-16 | 185 | EVQLVESGGGLVQAGGSLRLSCAASGRTSSPYTMGWFRQAPGKEREFVSAISWSGGSTVYADSVKGRFTISADNAKNTVYLQMNSLKPEDTAVYYCALIRRAPYSRLETWGQGTQVTVSS |
| GLP1R-43-17 | 186 | EVQLVESGGGLVQAGGSLRLSCAASGSIFPINAMGWFRQAPGKEREGVAAITNFGTTKYADSVKGRFTISADNAKNTVYLQMNSLKPEDTAVYYCAAVRWGPRNDDHYDWGQGTQVTVSS |
| GLP1R-43-18 | 187 | EVQLVESGGGLVQAGGSLRLSCAASGRTFDTYAMGWFRQAPGKEREFVAAITWGGGRTYYADSVKGRFTISADNAKNTVYLQMNSLKPEDTAVYYCAAVPRLYRDYDYWGQGTQVTVSS |
| GLP1R-43-19 | 188 | EVQLVESGGGLVQAGGSLRLSCAASGRRFSAYGMGWFRQAPGKEREFVAAVSWDGRNTYYADSVKGRFTISADNAKNTVYLQMNSLKPEDTAVYYCASTDDYGVDWGQGTQVTVSS |
| GLP1R-43-20 | 189 | EVQLVESGGGLVQAGGSLRLSCAASGSTFDNYAMGWFRQAPGKEREFVSAISGDGGTTYYADSVKGRFTISADNAKNTVYLQMNSLKPEDTAVYYCAAVPRLYRNRDYWGQGTQVTVSS |
| GLP1R-43-21 | 190 | EVQLVESGGGLVQAGGSLRLSCAASGSIFRINAMGWFRQAPGKEREGVSWITSFDASTYYADSVRGRFTISADNAKNTVYLQMNSLKPEDTAVYYCAAALDGYSGSWGQGTQVTVSS |
| GLP1R-43-22 | 191 | EVQLVESGGGLVQAGGSLRLSCAASGRTFSNYAMGWFRQAPGKEREFVSTISTGGSSTYYADSVKGRFTISADNAKNTVYLQMNSLKPEDTAVYYCAAVPTGRGRRDYWGQGTQVTVSS |
| GLP1R-43-23 | 192 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPVVPNTKDYWGQGTQVTVSS |

TABLE 11-continued

GLP1R Sequences

| GLP1R Variant | SEQ ID NO | Sequence |
|---|---|---|
| GLP1R-43-24 | 193 | EVQLVESGGGLVQAGGSLRLSCAASGNVFMIKDMGWFRQAPGKEREWVTAISWNGGSTDYADSVKGRFTISADNAKNTVYLQMNSLKPEDTAVYYCAAIVTYSDYDLGNDWGQGTQVTVSS |
| GLP1R-43-25 | 194 | EVQLVESGGGLVQAGGSLRLSCAASGFPFSIWPMGWFRQAPGKEREFIATIFSGGDTDYADSVKGRFTISADNAKNTVYLQMNSLKPEDTAVYYCAAIAYEEGVYRWDWGQGTQVTVSS |
| GLP1R-43-26 | 195 | EVQLVESGGGLVQAGGSLRLSCAASGRGFSRYAMGWFRQAPGKEREFVAAIRWSGKETWYADSVKGRFTISADNAKNTVYLQMNSLKPEDTAVYYCALGPVRRSRLEWGQGTQVTVSS |
| GLP1R-43-27 | 196 | EVQLVESGGGLVQAGGSLRLSCAASGRTSDIYGMGWFRQAPGKEREFVARIYWSSGNTYYADSVKGRFTISADNAKNTVYLQMNSLKPEDTAVYYCAAAYRFSDYSRPAGYDWGQGTQVTVSS |
| GLP1R-43-28 | 197 | EVQLVESGGGLVQAGGSLRLSCAASGNDFSFNSMGWFRQAPGKEREFLASVSWGFGSTYYADSVKGRFTISADNAKNTVYLQMNSLKPEDTAVYYCARAYGNPTWGQGTQVTVSS |
| GLP1R-43-29 | 198 | EVQLVESGGGLVQAGGSLRLSCAASGRTFTDYPMGWFRQAPGKERELESFVPINGTSTYYADSDSGRFTISADNAKNTVYLQMNSLKPEDTAVYYCAAALDGYSCSWGQGTQVTVSS |
| GLP1R-43-30 | 199 | EVQLVESGGGLVQAGGSLRLSCAASGRTFSIYAMGWFRQAPGKEREFVATISRGGSTTYYADSVKGRFTISADNAKNTVYLQMNSLKPEDTAVYYCAAGPRSGKDYWGQGTQVTVSS |
| GLP1R-43-31 | 200 | EVQLVESGGGLVQAGGSLRLSCAASGFIFQLYVMGWFRQAPGKEREGVTYINNIDGSTYYAYSVRGRFTISADNAKNTVYLQMNSLKPEDTAVYYCAAVRDGYSGSWGQGTQVTVSS |
| GLP1R-43-32 | 201 | EVQLVESGGGLVQAGGSLRLSCAASGSTFSSYAMEWFRQAPGKERELVATISRSGGRTYYADSVKGRFTISADNAKNTVYLQMNSLKPEDTAVYYCAAANWYYRYDYWGQGTQVTVSS |
| GLP1R-43-33 | 202 | EVQLVESGGGLVQAGGSLRLSCAASGFPFRINAMGWFRQAPGKERELVTAISSSGSSTYYADSVKGRFTISADNAKNTVYLQMNSLKPEDTAVYYCAASGYYATYYGERDYWGQGTQVTVSS |
| GLP1R-43-34 | 203 | EVQLVESGGGLVQAGGSLRLSCAASGFTLSSYTMGWFRQAPGKEREFVSAISRGGGNTYYADSVKGRFTISADNAKNTVYLQMNSLKPEDTAVYYCAAVPSYAEYDYWGQGTQVTVSS |
| GLP1R-43-35 | 204 | EVQLVESGGGLVQAGGSLRLSCAASGRTFSIYGMGWFRQAPGKEREGVAAINGGGDSTNYADSVKGRFTISADNAKNTVYLQMNSLKPEDTAVYYCAAASASPYSGRNYWGQGTQVTVSS |
| GLP1R-43-36 | 205 | EVQLVESGGGLVQAGGSLRLSCAASGLtfSTTVMGWFRQAPGKEREGDGYISITDGSTYYADSVKGRFTISADNAKNTVYLQMNSLKPEDTAVYYCSAALDGYSGSWGQGTQVTVSS |
| GLP1R-43-37 | 206 | EVQLVESGGGLVQAGGSLRLSCAASGRTLENYRMGWFRQAPGKEREFVAAVSWSSGNAYYADSVKGRFTISADNAKNTVYLQMNSLKPEDTAVYYCAANWKMLLGVENDWGQGTQVTVSS |
| GLP1R-43-38 | 207 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPTVYGERDYWGQGTQVTVSS |
| GLP1R-43-39 | 208 | EVQLVESGGGLVQAGGSLRLSCAASGSILSISPMGWFRQAPGKERELVAINFSWGTTDYADSvKGRFTISADNAKNTVYLQMNSLKPEDTAVYYCAAIAYEQGVYRWDWGQGTQVTVSS |
| GLP1R-43-40 | 209 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAERYRYSGYYARDSWGQGTQVTVSS |
| GLP1R-43-41 | 210 | EVQLVESGGGLVQAGGSLRLSCAASGFTLSDYAMGWFRQAPGKEREFVSAISRDGTTTYYADSVKGRFTISADNAKNTVYLQMNSLKPEDTAVYYCAAVPTSQYATDYWGQGTQVTVSS |
| GLP1R-43-42 | 211 | EVQLVESGGGLVQAGGSLRLSCAASGRDLDYYVMGWFRQAPGKERELVAIKFSGGTTDYADSVKGRFTISADNAKNTVYLQMNSLKPEDTAVYYCADIAYEEGVYRWDWGQGTQVTVSS |

TABLE 11-continued

GLP1R Sequences

| GLP1R Variant | SEQ ID NO | Sequence |
|---|---|---|
| GLP1R-43-43 | 212 | EVQLVESGGGLVQAGGSLRLSCAASGSIFTFNAMGWFRQAPGKEREFVAGITRSAVSTSYADSVKGRFTISADNAKNTVYLQMNSLKPEDTAVYYCAAFRGIMRPDWGQGTQVTVSS |
| GLP1R-43-44 | 213 | EVQLVESGGGLVQAGGSLRLSCAASGRTFDSYAMGWFRQAPGKEREFVAAITSSGGNTYYADSVKGRFTISADNAKNTVYLQMNSLKPEDTAVYYCAAVPARYGARDYWGQGTQVTVSS |
| GLP1R-43-45 | 214 | EVQLVESGGGLVQAGGSLRLSCAASGRTFNNDHMGWFRQAPGKEREFVAVIEIGGATNYADSVKGRFTISADNAKNTVYLQMNSLKPEDTAVYYCATWDGRQVWGQGTQVTVSS |
| GLP1R-43-46 | 215 | EVQLVESGGGLVQAGGSLRLSCAASGGTFRKLAMGWFRQAPGKERELVAAIRWSGGITWYADSVKGRFTISADNAKNTVYLQMNSLKPEDTAVYYCAATLAKGGGRWGQGTQVTVSS |
| GLP1R-43-47 | 216 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPRAPSDRDYWGQGTQVTVSS |
| GLP1R-43-48 | 217 | EVQLVESGGGLVQAGGSLRLSCAASGRTFRIYAMGWFRQAPGKERELVSSISWNSGSTYYADSVKGRFTISADNAKNTVYLQMNSLKPEDTAVYYCAAAAYSYTQGTTYESWGQGTQVTVSS |
| GLP1R-43-49 | 218 | EVQLVESGGGLVQAGGSLRLSCAASGRTFTSYRMGWFRQAPGKEREWMGTIDYSGRTYYADSVKGRFTISADNAKNTVYLQMNSLKPEDTAVYYCAAAMDGYSGSWGQGTQVTVSS |
| GLP1R-43-50 | 219 | EVQLVESGGGLVQAGGSLRLSCAASGRTFSIYAMGWFRQAPGKEREFVAAINWNGDTTYYADSVKGRFTISADNAKNTVYLQMNSLKPEDTAVYYCAAVPRYSDYDYWGQGTQVTVSS |
| GLP1R-43-51 | 220 | EVQLVESGGGLVQAGGSLRLSCAASGRFFSTRVMGWFRQAPGKERELVAIKFSGGTTDYADSVKGRFTISADNAKNTVYLQMNSLKPEDTAVYYCAAIAHEEGVYRWDWGQGTQVTVSS |
| GLP1R-43-52 | 221 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPSVYGTRDYWGQGTQVTVSS |
| GLP1R-43-53 | 222 | EVQLVESGGGLVQAGGSLRLSCAASGSTFSIDVMGWFRQAPGKEREGVSYISMSDGRTYYADSVKGRFTISADNAKNTVYLQMNSLKPEDTAVYYCAAELDGYSGSWGQGTQVTVSS |
| GLP1R-43-54 | 223 | EVQLVESGGGLVQAGGSLRLSCAASGLSFSGYTMGWFRQAPGKEREVVAAISRTGGSTYYADSVKGRFTISADNAKNTVYLQMNSLKPEDTAVYYCALIQRRAPYSRLETWGQGTQVTVSS |
| GLP1R-43-55 | 224 | EVQLVESGGGLVQAGGSLRLSCAASGSTLSIYGMGWFRQAPGKEREGVAAISWSDGSTSYADSVKGRFTISADNAKNTVYLQMNSLKPEDTAVYYCAAVADIGLASDFDYWGQGTQVTVSS |
| GLP1R-43-56 | 225 | EVQLVESGGGLVQAGGSLRLSCAASGSTFSNYAMGWFRQAPGKEREFVATITRSSGNTYYADSVKGRFTISADNAKNTVYLQMNSLKPEDTAVYYCAAVPFKPYSYDYWGQGTQVTVSS |
| GLP1R-43-57 | 226 | EVQLVESGGGLVQAGGSLRLSCAASGSTFSIYTMGWFRQAPGKEREFVAAISGSSDSTYYADSVKGRFTISADNAKNTVYLQMNSLKPEDTAVYYCATVPKTRYTRDYWGQGTQVTVSS |
| GLP1R-43-58 | 227 | EVQLVESGGGLVQAGGSLRLSCAASGNTFSSYAMGWFRQAPGKEREFVAIISRSGGRTYYADSVKGRFTISADNAKNTVYLQMNSLKPEDTAVYYCAAAPYNETNSWGQGTQVTVSS |
| GLP1R-43-59 | 228 | EVQLVESGGGLVQAGGSLRLSCAASGSTFSTYAMGWFRQAPGKEREFVASISRSGGRTYYADSVKGRFTISADNAKNTVYLQMNSLKPEDTAVYYCAAARYNERNSWGQGTQVTVSS |
| GLP1R-43-60 | 229 | EVQLVESGGGLVQAGGSLRLSCAASGGTLNNNPMAMGWFRQAPGKEREFVVAIYWSNGKTPYADSVKRRFTISADNAKNTVYLQMNSLKPEDTAVYYCAAALDGYSGAWGQGTQVTVSS |
| GLP1R-43-61 | 230 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPRAPSERDYWGQGTQVTVSS |

TABLE 11-continued

GLP1R Sequences

| GLP1R Variant | SEQ ID NO | Sequence |
|---|---|---|
| GLP1R-43-62 | 231 | EVQLVESGGGLVQAGGSLRLSCAASGRTFNNNDMGWFRQAPGKEREFVAVIKLGGATTYDDYSEGRFTISADNAKNTVYLQMNSLKPEDTAVYYCATWDARHVWGQGTQVTVSS |
| GLP1R-43-63 | 232 | EVQLVESGGGLVQAGGSLRLSCAASGRAFSYYNMGWFRQAPGKEREGVSWISSSDGSTYYADSVKGRFTISADNAKNTVYLQMNSLKPEDTAVYYCAAVLDGCSGSWGQGTQVTVSS |
| GLP1R-43-64 | 233 | EVQLVESGGGLVQAGGSLRLSCAASGSTFSTYAMGWFRQAPGKEREFVAAINRSGASTYYADSVKGRFTISADNAKNTVYLQMNSLKPEDTAVYYCAAALLGGRGGCGKGYWGQGTQVTVSS |
| GLP1R-43-65 | 234 | EVQLVESGGGLVQAGGSLRLSCAASGSILDTYAMGWFRQAPGKERELVSGINTSGDTTYYADSVKGRFTISADNAKNTVYLQMNSLKPEDTAVYYCAAVLAGYEYWGQGTQVTVSS |
| GLP1R-43-66 | 235 | EVQLVESGGGLVQAGGSLRLSCAASGSTLSINAMGWFRQAPGKEREFVAHMSHDGTTNYADSVKGRFTISADNAKNTVYLQMNSLKPEDTAVYYCARLPNYRWGQGTQVTVSS |
| GLP1R-43-67 | 236 | EVQLVESGGGLVQAGGSLRLSCAASGSIFRLNAMGWFRQAPGKEREGVAAINNFDTTKYADSSKGRFTISADNAKNTVYLQMNSLKPEDTAVYYCAAVRWGPRSDDRWGQGTQVTVSS |
| GLP1R-43-68 | 237 | EVQLVESGGGLVQAGGSLRLSCAASGLTNPPFDNFPMGWFRQAPGKEREFVAVISWTGGSTYYADSVKGRFTISADNAKNTVYLQMNSLKPEDTAVYYCPAVYPRYYGDDDRPPVDWGQGTQVTVSS |
| GLP1R-43-69 | 238 | EVQLVESGGGLVQAGGSLRLSCAASGPTFSKAVMGWFRQAPGKEREFVAAMNWSGRSTYYADSVKGRFTISADNAKNTVYLQMNSLKPEDTAVYYCAATPAGRGGYWGQGTQVTVSS |
| GLP1R-43-70 | 239 | EVQLVESGGGLVQAGGSLRLSCAASGSIFSDYAMGWFRQAPGKEREFVATINWGGGRTYYADSVKGRFTISADNAKNTVYLQMNSLKPEDTAVYYCAAVPKTRYARDYWGQGTQVTVSS |
| GLP1R-43-71 | 240 | EVQLVESGGGLVQAGGSLRLSCAASGFILSDYAMGWFRQAPGKEREFVAAISSSEASTYYADSVKGRFTISADNAKNTVYLQMNSLKPEDTAVYYCAAVRFWAGYDSWGQGTQVTVSS |
| GLP1R-43-72 | 241 | EVQLVESGGGLVQAGGSLRLSCAASGYTDYKYDMGWFRQAPGKEREFVAAISWGGGLTVYADSVKGRFTISADNAKNTVYLQMNSLKPEDTAVYYCAAVATVTDYTGTYSDGWGQGTQVTVSS |
| GLP1R-43-73 | 242 | EVQLVESGGGLVQAGGSLRLSCAASGRTFSNYAMGWFRQAPGKEREFVATINWGGGNTYYADSVKGRFTISADNAKNTVYLQMNSLKPEDTAVYYCAAVPKTRYAYDYWGQGTQVTVSS |
| GLP1R-43-74 | 243 | EVQLVESGGGLVQAGGSLRLSCAASGRTFSRYYMGWFRQAPGKERELVAVILRGGSTNYADSVKGRFTISADNAKNTVYLQMNSLKPEDTAVYYCAAARRYGNLYNTNNYDWGQGTQVTVSS |
| GLP1R-43-75 | 244 | EVQLVESGGGLVQAGGSLRLSCAASGSILSSYVMGWFRQAPGKEREFVSAISRSGTSTYYADSVKGRFTISADNAKNTVYLQMNSLKPEDTAVYYCAAVPKTRYDRDYWGQGTQVTVSS |
| GLP1R-43-76 | 245 | EVQLVESGGGLVQAGGSLRLSCAASGFTLDNYAMGWFRQAPGKEREFVAAISWSGGSTYYADSVKGRFTISADNAKNTVYLQMNSLKPEDTAVYYCAAVPKTRYSYDYWGQGTQVTVSS |
| GLP1R-43-77 | 246 | EVQLVESGGGLVQAGGSLRLSCAASGNTYSYKVMGWFRQAPGKEREFVGIIIRNGDTTYYADSVKGRFTISADNAKNTVYLQMNSLKPEDTAVYYCAASPKYMTAYERSYDWGQGTQVTVSS |
| GLP1R-43-78 | 247 | EVQLVESGGGLVQAGGSLRLSCAASGSIFRNYAMGWFRQAPGKEREFVATITTSGGNTYYADSVKGRFTISADNAKNTVYLQMNSLKPEDTAVYYCAAVPKTRYRRDYWGQGTQVTVSS |
| GLP1R-43-79 | 248 | EVQLVESGGGLVQAGGSLRLSCAASGFTFGTTTMGWFRQAPGKEREVVAAITGSGRSTYYADSVKGRFTISADNAKNTVYLQMNSLKPEDTAVYYCAASAIGSGALRRFEYDWGQGTQVTVSS |

TABLE 11-continued

GLP1R Sequences

| GLP1R Variant | SEQ ID NO | Sequence |
|---|---|---|
| GLP1R-43-80 | 249 | EVQLVESGGGLVQAGGSLRLSCAASGGTFSAYAMGWFRQAPGKEREGVAAIRWDGGYTRYADSVKGRFTISADNAKNTVYLQMNSLKPEDTAVYYCAATTPTTSYLPRSERQYEWGQGTQVTVSS |
| GLP1R-43-81 | 250 | EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPSVYGERDYWGQGTQVTVSS |
| GLP1R-43-82 | 251 | EVQLVESGGGLVQAGGSLRLSCAASGSFFSINAMGWFRQAPGKEREFVAGISQSGGSTAYADSVKGRFTISADNAKNTVYLQMNSLKPEDTAVYYCAAHRIVVGGTSVGDWRWGQGTQVTVSS |
| GLP1R-43-83 | 252 | EVQLVESGGGLVQAGGSLRLSCAASGRTFSSYRMGWFRQAPGKEREMVASITSRKIPKYADSVKGRFTISADNAKNTVYLQMNSLKPEDTAVYYCAVWSGRDWGQGTQVTVSS |
| GLP1R-43-84 | 253 | EVQLVESGGGLVQAGGSLRLSCAASGFTFRRYVMGWFRQAPGKEREFVAAISRDGDRTYYADSVKGRFTISADNAKNTVYLQMNSLKPEDTAVYYCASTRLAGRWYRDSEYKWGQGTQVTVSS |
| GLP1R-43-85 | 254 | EVQLVESGGGLVQAGGSLRLSCAASGRTFSDNAMGWFRQAPGKEREFVATISRGGSRTSYADSVKGRFTISADNAKNTVYLQMNSLKPEDTAVYYCAAGPRSGRDYWGQGTQVTVSS |
| GLP1R-43-86 | 255 | EVQLVESGGGLVQAGGSLRLSCAASGFTFRSYAMGWFRQAPGKEREFVATITRNGDNTYYADSVKGRFTISADNAKNTVYLQMNSLKPEDTAVYYCATVGTRYNYWGQGTQVTVSS |
| GLP1R-43-87 | 256 | EVQLVESGGGLVQAGGSLRLSCAASGSTFSDYVMGWFRQAPGKERELISGITWNGDTTYYADSVKGRFTISADNAKNTVYLQMNSLKPEDTAVYYCAVVRLGGYDYWGQGTQVTVSS |
| GLP1R-43-88 | 257 | EVQLVESGGGLVQAGGSLRLSCAASGGIISNYHMGWFRQAPGKEREFVATITRSGGSTYYADSVKGRFTISADNAKNTVYLQMNSLKPEDTAVYYCAMAGRGRWGQGTQVTVSS |
| GLP1R-43-89 | 258 | EVQLVESGGGLVQAGGSLRLSCAASGFSFDDDYVMGWFRQAPGKERELVSAIGWSGASTYYADSVKGRFTISADNAKNTVYLQMNSLKPEDTAVYYCAAYYTDYDEALEETRGSYDWGQGTQVTVSS |
| GLP1R-43-90 | 259 | EVQLVESGGGLVQAGGSLRLSCAASGSTFPIYAMGWFRQAPGKEREWVSGISSRDDTTYYADSVKGRFTISADNAKNTVYLQMNSLKPEDTAVYYCSAHRIVFRGTSVGDWRWGQGTQVTVSS |
| GLP1R-43-91 | 260 | EVQLVESGGGLVQAGGSLRLSCAASGRAFSYYNMGWFRQAPGKEREGVSWISSSDGSTYYADSVKGRFTISADNAKNTVYLQMNSLKPEDTAVYYCAAVLDGYSGSWGQGTQVTVSS |
| GLP1R-43-92 | 261 | EVQLVESGGGLVQAGGSLRLSCAASGSTFSIDVMGWFRQAPGKERELVAATGRRGGPTYYADSVKGRFTISADNAKNTVYLQMNSLKPEDTAVYYCAARTSYSGTYDYGVDWGQGTQVTVSS |
| GLP1R-43-93 | 262 | EVQLVESGGGLVQAGGSLRLSCAASGGTFSSYAMGWFRQAPGKEREFVAAINWSGSITYYADSVKGRFTISADNAKNTVYLQMNSLKPEDTAVYYCAVGRSGRDYWGQGTQVTVSS |
| GLP1R-43-94 | 263 | EVQLVESGGGLVQAGGSLRLSCAASGSIFRINAMGWFRQAPGKEREGVAAINNFGTTKYADSVKGRFTISADNAKNTVYLQMNSLKPEDTAVYYCAAVRWGPRNDDRYDWGQGTQVTVSS |
| GLP1R-43-95 | 264 | EVQLVESGGGLVQAGGSLRLSCAASGGTLNNNPMAMGWFRQAPGKEREFVVAIYWSNGKTQYADSVKGRFTISADNAKNTVYLQMNSLKPEDTAVYYCAAALDGYSGSWGQGTQVTVSS |
| GLP1R-43-96 | 265 | EVQLVESGGGLVQAGGSLRLSCAASGRTFNNDHMGWFRQAPGKEREFVAVIEIGGATNYADSVKGRFTISADNAKNTVYLQMNSLKPEDTAVYYCASWDGRQVWGQGTQVTVSS |
| GLP1R-41-01 | 266 | EVQLVESGGGLVQPGGSLRLSCAASGRTFAMGWMGWFRQAPGKEREFVARVSWDGRNAYYANSRFGRFTISADNSKNTAYLQMNSLKPEDTAVYYCPRYVSPARDHGCWGQGTLVTVSS |
| GLP1R-41-02 | 267 | EVQLVESGGGLVQPGGSLRLSCAASGLTISTYIMGWFRQAPGKEREFVAVVNWNGDSTYYADSVKGRFTISADNSKNTAYLQMNSLKPEDTAVYYCAAYYTDYDEALEETRGSYDWGQGTLVTVSS |

TABLE 11-continued

GLP1R Sequences

| GLP1R Variant | SEQ ID NO | Sequence |
|---|---|---|
| GLP1R-41-03 | 268 | EVQLVESGGGLVQPGGSLRLSCAASGTLFKINAMGWFRQAPGKERELVAAINRGGKITHYADSVKGRFTISADNSKNTAYLQMNSLKPEDTAVYYCAASLRNSGSNVEGRWGQGTLVTVSS |
| GLP1R-41-04 | 269 | EVQLVESGGGLVQPGGSLRLSCAASGVTLDLYAMGWFRQAPGKEREFVAAISPSAVTTYYADSVKGRFTISADNSKNTAYLQMNSLKPEDTAVYYCAAYDYYSDYPLPDANEYEWGQGTLVTVSS |
| GLP1R-41-05 | 270 | EVQLVESGGGLVQPGGSLRLSCAASGRTFSDYIMGWFRQAPGKEREFVAVINRSGSTTYYADSVKGRFTISADNSKNTAYLQMNSLKPEDTAVYYCAAVQAYSNSSDYYSQEGAYDWGQGTLVTVSS |
| GLP1R-41-06 | 271 | EVQLVESGGGLVQPGGSLRLSCAASGFTFSNYVMGWFRQAPGKEREGVSYISSSDGRTHYADSVKGRFTISADNSKNTAYLQMNSLKPEDTAVYYCAAVLDGYNGSWGQGTLVTVSS |
| GLP1R-41-07 | 272 | EVQLVESGGGLVQPGGSLRLSCAASGFTFSRFGMGWFRQAPGKEREGVAAIGSDGSTSYADSVKGRFTISADNSKNTAYLQMNSLKPEDTAVYYCASGRDRYARDLSEYEYVWGQGTLVTVSS |
| GLP1R-41-08 | 273 | EVQLVESGGGLVQPGGSLRLSCAASGFTFRFNAMGWFRQAPGKEREFVAAINWRGSHPYYADSVKGRFTISADNSKNTAYLQMNSLKPEDTAVYYCAAATLGEPLVKYTWGQGTLVTVSS |
| GLP1R-41-09 | 274 | EVQLVESGGGLVQPGGSLRLSCAASGGTFGVYHMGWFRQAPGKEREFLASVTWGFGSTYYADSVKGRFTISADNSKNTAYLQMNSLKPEDTAVYYCAATTTRSYDDTYRNSWVYNWGQGTLVTVSS |
| GLP1R-41-10 | 275 | EVQLVESGGGLVQPGGSLRLSCAASGFSFDDYAMGWFRQAPGKERELVAAIRWSGGITWYADSVKGRFTISADNSKNTAYLQMNSLKPEDTAVYYCAAYGSGSDYLPMDWGQGTLVTVSS |
| GLP1R-41-11 | 276 | EVQLVESGGGLVQPGGSLRLSCAASGPTFTIYAMGWFRQAPGKEREFVGAISMSGEDTIYADSEKGRFTISADNSKNTAYLQMNSLKPEDTAVYYCAAVQAYTSNTNYYNQEGAYDWGQGTLVTVSS |
| GLP1R-41-12 | 277 | EVQLVESGGGLVQPGGSLRLSCAASGPTFSNYYVGWFRQAPGKEREFVAAILCSGGITCYADSVKGRFTISADNSKNTAYLQMNSLKPEDTAVYYCAAALDGYIGTWGQGTLVTVSS |
| GLP1R-41-13 | 278 | EVQLVESGGGLVQPGGSLRLSCAASGGTFSSIGMGWFRQAPGKEREGVAAIGSDGSTSYADSVKGRFTISADNSKNTAYLQMNSLKPEDTAVYYCAAASDRYARVLTEYEYVWGQGTLVTVSS |
| GLP1R-41-14 | 279 | EVQLVESGGGLVQPGGSLRLSCAASGVTFNNYGMGWFRQAPGKERELVAAIRWSGSATFYADSVKGRFTISADNSKNTAYLQMNSLKPEDTAVYYCAADDGARGSWGQGTLVTVSS |
| GLP1R-41-15 | 280 | EVQLVESGGGLVQPGGSLRLSCAASGRTFTMDGMGWFRQAPGKEREGVAAIGSDGSTSYADSVKGRFTISADNSKNTAYLQMNSLKPEDTAVYYCAAGSNIGGSRWRYDWGQGTLVTVSS |
| GLP1R-41-16 | 281 | EVQLVESGGGLVQPGGSLRLSCAASGGIFRFNAMGWFRQAPGKERELVAAISPAALTTYYADSVKGRFTISADNSKNTAYLQMNSLKPEDTAVYYCAAYLPSPYYSSYYDSTKYEWGQGTLVTVSS |
| GLP1R-41-17 | 282 | EVQLVESGGGLVQPGGSLRLSCAASGSGFSPNVMGWFRQAPGKEREVVAAISWNGGSTYYADSVKGRFTISADNSKNTAYLQMNSLKPEDTAVYYCAASAIGSGALRRFEYDWGQGTLVTVSS |
| GLP1R-41-18 | 283 | EVQLVESGGGLVQPGGSLRLSCAASGFTFGFYAMGWFRQAPGKERELVAAISWSDASTYYADSVKGRFTISADNSKNTAYLQMNSLKPEDTAVYYCALDNRRSYVDYYNVSEYDWGQGTLVTVSS |
| GLP1R-41-19 | 284 | EVQLVESGGGLVQPGGSLRLSCAASGFTFSIYPMGWFRQAPGKERECVSTIWSRGDTYYADNVKGRFTISADNSKNTAYLQMNSLKPEDTAVYYCAAALDGYSATWGQGTLVTVSS |
| GLP1R-41-20 | 285 | EVQLVESGGGLVQPGGSLRLSCAASGFTFDYYAMGWFRQAPGKERELVAAISWSNDITYYADSVKGRFTISADNSKNTAYLQMNSLKPEDTAVYYCALDNRRSYVDYYSVSEYDWGQGTLVTVSS |

TABLE 11-continued

GLP1R Sequences

| GLP1R Variant | SEQ ID NO | Sequence |
|---|---|---|
| GLP1R-41-21 | 286 | EVQLVESGGGLVQPGGSLRLSCAASGGTFSTYTMGWFRQAPGKEREFVAGIYNDGTASYYADSVKGRFTISADNSKNTAYLQMNSLKPEDTAVYYCAAFDGYTGNDWGQGTLVTVSS |
| GLP1R-41-22 | 287 | EVQLVESGGGLVQPGGSLRLSCAASGVTLDLYAMGWFRQAPGKEREWVARMYLDGDYPYYADSVKGRFTISADNSKNTAYLQMNSLKPEDTAVYYCAAVLDGYSGSWGQGTLVTVSS |
| GLP1R-41-23 | 288 | EVQLVESGGGLVQPGGSLRLSCAASGRTISRYIMGWFRQAPGKERELVAAINRSGKSTYYADSVKGRFTISADNSKNTAYLQMNSLKPEDTAVYYCASTRFAGRWYRDSEYKWGQGTLVTVSS |
| GLP1R-41-24 | 289 | EVQLVESGGGLVQPGGSLRLSCAASGRTLSVYAMGWFRQAPGKEREFVAAVRWSGGITWYVDSVKGRFTISADNSKNTAYLQMNSLKPEDTAVYYCAAFDGYSGSDWGQGTLVTVSS |
| GLP1R-41-25 | 290 | EVQLVESGGGLVQPGGSLRLSCAASGSIFSITEMGWFRQAPGKERELVAAIAVGGGITWYADSVKGRFTISADNSKNTAYLQMNSLKPEDTAVYYCAAHDVDDDESPYYSGGYYRALYDWGQGTLVTVSS |
| GLP1R-41-26 | 291 | EVQLVESGGGLVQPGGSLRLSCAASGSIYSLDAMGWFRQAPGKERELVAAISPAALTTYYADSVKGRFTISADNSKNTAYLQMNSLKPEDTAVYYCAASMSLRPLDPASYSPDIQPYDWGQGTLVTVSS |
| GLP1R-41-27 | 292 | EVQLVESGGGLVQPGGSLRLSCAASGFTCGDYTMGWFRQAPGKERESVAAIDSDGRTHYADSVISRFTISADNSKNTAYLQMNSLKPEDTAVYYCAAALDGYSGDWGQGTLVTVSS |
| GLP1R-41-28 | 293 | EVQLVESGGGLVQPGGSLRLSCAASGRTLSfYAMGWFRQAPGKEREFVAAINRGGRISHYADSVKGRFTISADNSKNTAYLQMNSLKPEDTAVYYCAAGRRYGSPPHDGSSYEWGQGTLVTVSS |
| GLP1R-41-29 | 294 | EVQLVESGGGLVQPGGSLRLSCAASGFTFDDYAMGWFRQAPGKEREFVAGISWTGGITYYADSVKGRFTISADNSKNTAYLQMNSLKPEDTAVYYCAVNVGFEWGQGTLVTVSS |
| GLP1R-41-30 | 295 | EVQLVESGGGLVQPGGSLRLSCAASGFTFDDYGMGWFRQAPGKEREGVAAIGSDGSTSYADSVKGRFTISADNSKNTAYLQMNSLKPEDTAVYYCAATLRATITNFDEYVWGQGTLVTVSS |
| GLP1R-41-31 | 296 | EVQLVESGGGLVQPGGSLRLSCAASGRTFNRYPMGWFRQAPGKEREFVAHMSHDGTTNYADSVKGRFTISADNSKNTAYLQMNSLKPEDTAVYYCAAPGTRYYGSNQVNYNWGQGTLVTVSS |
| GLP1R-41-32 | 297 | EVQLVESGGGLVQPGGSLRLSCAASGSIFSFNAMGWFRQAPGKEREFVAGITRRGLSTSYADSVKGRFTISADNSKNTAYLQMNSLKPEDTAVYYCAAAKGIGVYGWGQGTLVTVSS |
| GLP1R-41-33 | 298 | EVQLVESGGGLVQPGGSLRLSCAASGGSISSINAMGWFRQAPGKERELVAGIITSGDSTYYADSVKGRFTISADNSKNTAYLQMNSLKPEDTAVYYCAAGSAYVAGVRRRNAYHWGQGTLVTVSS |
| GLP1R-41-34 | 299 | EVQLVESGGGLVQPGGSLRLSCAASGGTFSADVMGWFRQAPGKEREFVAAISTGSITIYADSVKGRFTISADNSKNTAYLQMNSLKPEDTAVYYCATYGYDSGLYFITDSNDYEWGQGTLVTVSS |
| GLP1R-41-35 | 300 | EVQLVESGGGLVQPGGSLRLSCAASGFTFDDAAMGWFRQAPGKEREFVAAMRWRGGITWYADSVKGRFTISADNSKNTAYLQMNSLKPEDTAVYYCAAQGTLYDDYDGLPIKYDWGQGTLVTVSS |
| GLP1R-41-36 | 301 | EVQLVESGGGLVQPGGSLRLSCAASGDIFNINAMGWFRQAPGKEREPVAAISPAALTTYYADSVKGRFTISADNSKNTAYLQMNSLKPEDTAVYYCAATPIERLGLDAYEYDWGQGTLVTVSS |
| GLP1R-41-37 | 302 | EVQLVESGGGLVQPGGSLRLSCAASGRTFSTYNMGWFRQAPGKEREFVAAINWSGGITWYADSVKGRFTISADNSKNTAYLQMNSLKPEDTAVYYCAAEPPDSSWYLDGSPEFFKWGQGTLVTVSS |
| GLP1R-41-38 | 303 | EVQLVESGGGLVQPGGSLRLSCAASGSISVFDAMGWFRQAPGKERELVAGISGSGGDTYYADSVKGRFTISADNSKNTAYLQMNSLKPEDTAVYYCAASPKYSTHSIFDASPYNWGQGTLVTVSS |
| GLP1R-41-39 | 304 | EVQLVESGGGLVQPGGSLRLSCAASGFTSDDYAMGWFRQAPGKEREFVAALRWSSSNIDYTYYADSVKGRFTISADNSKNTAYLQMNSLKPEDTAVYYCATDLSGHGDVSEYEYDWGQGTLVTVSS |

TABLE 11-continued

| GLP1R Sequences | | |
|---|---|---|
| GLP1R Variant | SEQ ID NO | Sequence |
| GLP1R-41-40 | 305 | EVQLVESGGGLVQPGGSLRLSCAASGFTFSPNVMGWFRQAPGKEREFVAAITSSGETTWYADSVKGRFTISADNSKNTAYLQMNSLKPEDTAVYYCAAEPYGSGSSLMSEYDWGQGTLVTVSS |
| GLP1R-41-41 | 306 | EVQLVESGGGLVQPGGSLRLSCAASGRNLRMYRMGWFRQAPGKEREFVAAINWSGDNTHYADSVKGRFTISADNSKNTAYLQMNSLKPEDTAVYYCAANWKMLLGVENDWGQGTLVTVSS |
| GLP1R-41-42 | 307 | EVQLVESGGGLVQPGGSLRLSCAASGDTFNCYAMGWFRQAPGKEREFVAVINWSGDNTHYADSVKGRFTISADNSKNTAYLQMNSLKPEDTAVYYCAAYYTDYDEALEETRGRYDWGQGTLVTVSS |
| GLP1R-41-43 | 308 | EVQLVESGGGLVQPGGSLRLSCAASGSISTINVMGWFRQAPGKEREFVAAISPSAVTTYYADSVKGRFTISADNSKNTAYLQMNSLKPEDTAVYYCATDLSGRGDVSEYEYDWGQGTLVTVSS |
| GLP1R-41-44 | 309 | EVQLVESGGGLVQPGGSLRLSCAASGRTLSKYRMGWFRQAPGKEREFVAAIRWSGGITWYADSVKGRFTISADNSKNTAYLQMNSLKPEDTAVYYCAIPHGIAGRITWGQGTLVTVSS |
| GLP1R-41-45 | 310 | EVQLVESGGGLVQPGGSLRLSCAASGFTFGSYAMGWFRQAPGKERELVAGIDQSGGITWYADSVKGRFTISADNSKNTAYLQMNSLKPEDTAVYYCAADDYLGGDNWYLGPYDWGQGTLVTVSS |
| GLP1R-41-46 | 311 | EVQLVESGGGLVQPGGSLRLSCAASGFTIDDYAMGWFRQAPGKEREFVAAVSGTGTIAYYADSVKGRFTISADNSKNTAYLQMNSLKPEDTAVYYCAAYYIDYDEALEETRGSYDWGQGTLVTVSS |
| GLP1R-41-47 | 312 | EVQLVESGGGLVQPGGSLRLSCAASGRTFNNYVMGWFRQAPGKERELVAGITSGRDITYYADSVKGRFTISADNSKNTAYLQMNSLKPEDTAVYYCAADGVLATTLNWDWGQGTLVTVSS |
| GLP1R-41-48 | 313 | EVQLVESGGGLVQPGGSLRLSCAASGSGISFNAMGWFRQAPGKERELVAAISRSGDTTYYADSVKGRFTISADNSKNTAYLQMNSLKPEDTAVYYCAADLTTWADGPYRWGQGTLVTVSS |
| GLP1R-41-49 | 314 | EVQLVESGGGLVQPGGSLRLSCAASGRTFSfYAMGWFRQAPGKEREFVAAINRGGKISHYADSVKGRFTISADNSKNTAYLQMNSLKPEDTAVYYCAAVRRYGNPPHDGSSYEWGQGTLVTVSS |
| GLP1R-41-50 | 315 | EVQLVESGGGLVQPGGSLRLSCAASGRTFSfYGMGWFRQAPGKERELVAIKFSGGTTDYADSvkGRFTISADNSKNTAYLQMNSLKPEDTAVYYCAAIAHEEGVYRWGQGTLVTVSS |
| GLP1R-41-51 | 316 | EVQLVESGGGLVQPGGSLRLSCAASGGIFRFNAMGWFRQAPGKERELVAGISGSGGDTYYADSVKGRFTISADNSKNTAYLQMNSLKPEDTAVYYCAAFRGIMRPDWGQGTLVTVSS |
| GLP1R-41-52 | 317 | EVQLVESGGGLVQPGGSLRLSCAASGRTFSfYAMGWFRQAPGKEREFVAAINRGGKISHYADSVKGRFTISADNSKNTAYLQMNSLKPEDTAVYYCAAVRRYGSPPHDGSSYEWGQGTLVTVSS |
| GLP1R-41-53 | 318 | EVQLVESGGGLVQPGGSLRLSCAASGSDFSLNAMGWFRQAPGKEREFVAAISWSGGSTLYADSVKGRFTISADNSKNTAYLQMNSLKPEDTAVYYCASNESDAYNWGQGTLVTVSS |
| GLP1R-41-54 | 319 | EVQLVESGGGLVQPGGSLRLSCAASGRTLVNYDMGWFRQAPGKEREFVAAIRWSGGITWYADSVKGRFTISADNSKNTAYLQMNSLKPEDTAVYYCAAFRGIMLPPWGQGTLVTVSS |
| GLP1R-41-55 | 320 | EVQLVESGGGLVQPGGSLRLSCAASGRTFEKDAMGWFRQAPGKEREMVAAIRWSGGITCYADSVKGRFTISADNSKNTAYLQMNSLKPEDTAVYYCAAYGSLPDDYDGLECEYDWGQGTLVTVSS |
| GLP1R-41-56 | 321 | EVQLVESGGGLVQPGGSLRLSCAASGSFFKINAMGWFRQAPGKEREFVAGITRSGGSTYYADSVKGRFTISADNSKNTAYLQMNSLKPEDTAVYYCAAESLGRWWGQGTLVTVSS |
| GLP1R-41-57 | 322 | EVQLVESGGGLVQPGGSLRLSCAASGRTFSIDAMGWFRQAPGKEREFVAAIRWSGGITWYADSVKGRFTISADNSKNTAYLQMNSLKPEDTAVYYCAASHDSDWGQGTLVTVSS |

TABLE 11-continued

| GLP1R Sequences | | |
|---|---|---|
| GLP1R Variant | SEQ ID NO | Sequence |
| GLP1R-41-58 | 323 | EVQLVESGGGLVQPGGSLRLSCAASGRTFSIDAMGWFRQAPGKEREFVAAIRWSGGITWYADSVKGRFTISADNSKNTAYLQMNSLKPEDTAVYYCAASHDSDYGGTNANLYDWGQGTLVTVSS |
| GLP1R-41-59 | 324 | EVQLVESGGGLVQPGGSLRLSCAASGRTDRSNVMGWFRQAPGKEREFVAAINRSGSTFYADSVKGRFTISADNSKNTAYLQMNSLKPEDTAVYYCAKTKRTGIFTTARMVDWGQGTLVTVSS |
| GLP1R-41-60 | 325 | EVQLVESGGGLVQPGGSLRLSCAASGSFFSINVMGWFRQAPGKERELVAATGRRGGPTYYADSVKGRFTISADNSKNTAYLQMNSLKPEDTAVYYCAAHRIVVGGTSVGDWRWGQGTLVTVSS |
| GLP1R-41-61 | 326 | EVQLVESGGGLVQPGGSLRLSCAASGFTWGDYTMGWFRQAPGKEREGVAAIDSDGRTRYADSVKGRFTISADNSKNTAYLQMNSLKPEDTAVYYCAAALDGYSGNWGQGTLVTVSS |
| GLP1R-41-62 | 327 | EVQLVESGGGLVQPGGSLRLSCAASGNIFSLNTMGWFRQAPGKEREFVAAINCSGNHPYYADSVKGRFTISADNSKNTAYLQMNSLKPEDTAVYYCAAIVTYSDDDGRDNWGQGTLVTVSS |
| GLP1R-41-63 | 328 | EVQLVESGGGLVQPGGSLRLSCAASGSIFSINAMGWFRQAPGKEREFVAAVSGSGDDTYYADSVKGRFTISADNSKNTAYLQMNSLKPEDTAVYYCAAVQAYSSSSDYYSQEGAYDWGQGTLVTVSS |
| GLP1R-41-64 | 329 | EVQLVESGGGLVQPGGSLRLSCAASGFTFPAYVMGWFRQAPGKERELLAVITRDGSTHYADSVKGRFTISADNSKNTAYLQMNSLKPEDTAVYYCAVNGRWRIWSSRNPWGQGTLVTVSS |
| GLP1R-41-65 | 330 | EVQLVESGGGLVQPGGSLRLSCAASGFSFDDDYVMGWFRQAPGKERELVAVIGWGGKETWYADSVKGRFTISADNSKNTAYLQMNSLKPEDTAVYYCAAEDPSMGYYTLEEYEYDWGQGTLVTVSS |
| GLP1R-41-66 | 331 | EVQLVESGGGLVQPGGSLRLSCAASGPTFDTYVMGWFRQAPGKEREFVAAISMSGDDTAYADSVKGRFTISADNSKNTAYLQMNSLKPEDTAVYYCATDLRGRGDVSEYEYDWGQGTLVTVSS |
| GLP1R-41-67 | 332 | EVQLVESGGGLVQPGGSLRLSCAASGRTFSIDAMGWFRQAPGKEREFVGAITWGGGNTYYADSVKGRFTISADNSKNTAYLQMNSLKPEDTAVYYCAAIVTDGDYDGWGQGTLVTVSS |
| GLP1R-41-68 | 333 | EVQLVESGGGLVQPGGSLRLSCAASGNTFSINVMGWFRQAPGKEREFVAAINWNGGSTDYADSVKGRFTISADNSKNTAYLQMNSLKPEDTAVYYCAAIVTYSDYDLDNDWGQGTLVTVSS |
| GLP1R-41-69 | 334 | EVQLVESGGGLVQPGGSLRLSCAASGFTFSTHWMGWFRQAPGKEREVVAVIYTSDGSTYYADSVKGRFTISADNSKNTAYLQMNSLKPEDTAVYYCAANEYGLGSSIYAYKWGQGTLVTVSS |
| GLP1R-41-70 | 335 | EVQLVESGGGLVQPGGSLRLSCAASGRTFSISAMGWFRQAPGKEREFVAAISRSGGTTYYADSVKGRFTISADNSKNTAYLQMNSLKPEDTAVYYCATDEDYALGPNEYDWGQGTLVTVSS |
| GLP1R-41-71 | 336 | EVQLVESGGGLVQPGGSLRLSCAASGSTFRINAMGWFRQAPGKERELVAAISPAALTTYYADSVKGRFTISADNSKNTAYLQMNSLKPEDTAVYYCAAEPYGSGSLYDDYDGLPIKYDWGQGTLVTVSS |
| GLP1R-41-72 | 337 | EVQLVESGGGLVQPGGSLRLSCAASGFTDGIDAMGWFRQAPGKEREFVAAISWSNDITYYADSVKGRFTISADNSKNTAYLQMNSLKPEDTAVYYCAAALSEVWRGSENLREGYDWGQGTLVTVSS |
| GLP1R-41-73 | 338 | EVQLVESGGGLVQPGGSLRLSCAASGLPVDYYAMGWFRQAPGKERELVAAISGSGDSTYYADSVKGRFTISADNSKNTAYLQMNSLKPEDTAVYYCAAQTEDSASIFGYGMDWGQGTLVTVSS |
| GLP1R-41-74 | 339 | EVQLVESGGGLVQPGGSLRLSCAASGRTLSTVNMGWFRQAPGKEREFVGAISRSGETTWYADSVKGRFTISADNSKNTAYLQMNSLKPEDTAVYYCAVDCPDYYSDYECPLEWGQGTLVTVSS |
| GLP1R-41-75 | 340 | EVQLVESGGGLVQPGGSLRLSCAASGFSFDDYAMGWFRQAPGKERELVAAVRWSGGITWYADSVKGRFTISADNSKNTAYLQMNSLKPEDTAVYYCAAGDTGGAAYGWGQGTLVTVSS |
| GLP1R-41-76 | 341 | EVQLVESGGGLVQPGGSLRLSCAASGSTLSINAMGWFRQAPGKEREGVSWISSSDGSTYYADSVKGRFTISADNSKNTAYLQMNSLKPEDTAVYYCAAALDGYSGRWGQGTLVTVSS |

TABLE 11-continued

| GLP1R Sequences | | |
|---|---|---|
| GLP1R Variant | SEQ ID NO | Sequence |
| GLP1R-41-77 | 342 | EVQLVESGGGLVQPGGSLRLSCAASGSSVSIDAMGWFRQAPGKEREFVAGISRSGDTTYYADSVKGRFTISADNSKNTAYLQMNSLKPEDTAVYYCAASYNVYYNNYYYPISRDEYDWGQGTLVTVSS |
| GLP1R-41-78 | 343 | EVQLVESGGGLVQPGGSLRLSCAASGSIFRVNVMGWFRQAPGKERELVAVTWSGGSTNYADSVKGRFTISADNSKNTAYLQMNSLKPEDTAVYYCAAIAYEEGVYRWDWGQGTLVTVSS |
| GLP1R-41-79 | 344 | EVQLVESGGGLVQPGGSLRLSCAASGRTFSfYAMGWFRQAPGKEREFVAVVNWSGRRTYYADSVKGRFTISADNSKNTAYLQMNSLKPEDTAVYYCAASSRMGVDDPETYGWGQGTLVTVSS |
| GLP1R-41-80 | 345 | EVQLVESGGGLVQPGGSLRLSCAASGFTFDDAAMGWFRQAPGKEREFVAAVRWRGGITWYADSVKGRFTISADNSKNTAYLQMNSLKPEDTAVYYCAAQGSLYDDYDGLPIKYDWGQGTLVTVSS |
| GLP1R-41-81 | 346 | EVQLVESGGGLVQPGGSLRLSCAASGSIFRINAMGWFRQAPGKERELVASISRFGRTNYADSVKGRFTISADNSKNTAYLQMNSLKPEDTAVYYCAANGIESWGQGTLVTVSS |
| GLP1R-41-82 | 347 | EVQLVESGGGLVQPGGSLRLSCAASGFTWGDYTMGWFRQAPGKEREFVASITSGGRMWYADSVKGRFTISADNSKNTAYLQMNSLKPEDTAVYYCAAALDGYSGSWGQGTLVTVSS |
| GLP1R-41-83 | 348 | EVQLVESGGGLVQPGGSLRLSCAASGFRFSSYGMGWFRQAPGKEREGVAAIGSDGSTSYADSVKGRFTISADNSKNTAYLQMNSLKPEDTAVYYCASWDGRQVWGQGTLVTVSS |
| GLP1R-41-84 | 349 | EVQLVESGGGLVQPGGSLRLSCAASGRTFDNYNMGWFRQAPGKEREFVAAISWNGVTIYYADSVKGRFTISADNSKNTAYLQMNSLKPEDTAVYYCAAQGSLYDDWGQGTLVTVSS |
| GLP1R-41-85 | 350 | EVQLVESGGGLVQPGGSLRLSCAASGFTFSTYSMGWFRQAPGKEREFVAAISSGGLKAYADSVKGRFTISADNSKNTAYLQMNSLKPEDTAVYYCAAALDDYSGSWGQGTLVTVSS |
| GLP1R-41-86 | 351 | EVQLVESGGGLVQPGGSLRLSCAASGYTFRAYVMGWFRQAPGKERELLAVITRDGSTHYADSVKGRFTISADNSKNTAYLQMNSLKPEDTAVYYCAVNGRWRSWSSRNPWGQGTLVTVSS |
| GLP1R-41-87 | 352 | EVQLVESGGGLVQPGGSLRLSCAASGRTFSIYAMGWFRQAPGKEREFVAAISRGSNSTDYADSVKGRFTISADNSKNTAYLQMNSLKPEDTAVYYCAAIVTYTDYDLWGQGTLVTVSS |
| GLP1R-41-88 | 353 | EVQLVESGGGLVQPGGSLRLSCAASGRTISSYAMGWFRQAPGKERELVAAISKSSISTYYADSVKGRFTISADNSKNTAYLQMNSLKPEDTAVYYCALGPVRRSRLEWGQGTLVTVSS |
| GLP1R-41-89 | 354 | EVQLVESGGGLVQPGGSLRLSCAASGPTFDTYVMGWFRQAPGKEREFVAAISWTGDSSSDGDTYYADSVKGRFTISADNSKNTAYLQMNSLKPEDTAVYYCAAAIFDVTDYERADWGQGTLVTVSS |
| GLP1R-41-90 | 355 | EVQLVESGGGLVQPGGSLRLSCAASGFTLGNYAMGWFRQAPGKERELVSAITWSDGSSYYADSVKGRFTISADNSKNTAYLQMNSLKPEDTAVYYCASTRFAGRWGQGTLVTVSS |
| GLP1R-41-91 | 356 | EVQLVESGGGLVQPGGSLRLSCAASGNIDRLYAMGWFRQAPGKEREPVAAISPAAVTAGMTYYADSVKGRFTISADNSKNTAYLQMNSLKPEDTAVYYCAAYGSGSYYYTDDELDWGQGTLVTVSS |
| GLP1R-41-92 | 357 | EVQLVESGGGLVQPGGSLRLSCAASGRTFGRRAMGWFRQAPGKERELVAAIRWSGKETWYADSVKGRFTISADNSKNTAYLQMNSLKPEDTAVYYCAAGNGGRTYGHSRARYEWGQGTLVTVSS |
| GLP1R-41-93 | 358 | EVQLVESGGGLVQPGGSLRLSCAASGRTFSIGAMGWFRQAPGKEREYVGSITWRGGNTYYADSVKGRFTISADNSKNTAYLQMNSLKPEDTAVYYCAAGVTGGAAYGWGQGTLVTVSS |
| GLP1R-41-94 | 359 | EVQLVESGGGLVQPGGSLRLSCAASGLTFSTYWMGWFRQAPGKEREVVAVIYTSDGSTYYADSVKGRFTISADNSKNTAYLQMNSLKPEDTAVYYCATIDGSWREWGQGTLVTVSS |

TABLE 11-continued

| GLP1R Sequences | | |
|---|---|---|
| GLP1R Variant | SEQ ID NO | Sequence |
| GLP1R-41-95 | 360 | EVQLVESGGGLVQPGGSLRLSCAASGFGIDfyAMGWFRQAPGKEREFVAAISGSGDDTYYADSVKGRFTISADNSKNTAYLQMNSLKPEDTAVYYCAASASDYGLGLELFHDEYNWGQGTLVTVSS |
| GLP1R-41-96 | 361 | EVQLVESGGGLVQPGGSLRLSCAASGNILSLNTMGWFRQAPGKEREFVASVTWGFGSTSYADSVKGRFTISADNSKNTAYLQMNSLKPEDTAVYYCAAIVTYSDYDLGNDWGQGTLVTVSS |
| GLP1R-41-97 | 362 | EVQLVESGGGLVQPGGSLRLSCAASGSIYSLDAMGWFRQAPGKEREFVAAISPAALTTYYADSVKGRFTISADNSKNTAYLQMNSLKPEDTAVYYCAGSSRIYIYSDSLSERSYDWGQGTLVTVSS |
| GLP1R-41-98 | 363 | EVQLVESGGGLVQPGGSLRLSCAASGRTFSfYGMGWFRQAPGKERELVAIKFSGGTTDYADSVKGRFTISADNSKNTAYLQMNSLKPEDTAVYYCAAIAHEEGVYRWDWGQGTLVTVSS |
| GLP1R-41-99 | 364 | EVQLVESGGGLVQPGGSLRLSCAASGRTFSKYAMGWFRQAPGKEREFVAAIRWSGGTTFYADSVKGRFTISADNSKNTAYLQMNSLKPEDTAVYYCAAGGWGTGRYNWGQGTLVTVSS |
| GLP1R-44-01 | 365 | EVQLVESGGGLVQPGGSLRLSCAASGSIFSIYAMDWFRQAPGKEREFVAAISSDDSTTYYADSVKGRFTISADNSKNTAYLQMNSLKPEDTAVYYCTAVLPAYDDWGQGTLVTVSS |
| GLP1R-44-02 | 366 | EVQLVESGGGLVQPGGSLRLSCAASGFNSGSYTMGWFRQAPGKEREGVSYISSSDGRTYYADSVKGRFTISADNSKNTAYLQMNSLKPEDTAVYYCAAGLNGAAAAWGQGTLVTVSS |
| GLP1R-44-03 | 367 | EVQLVESGGGLVQPGGSLRLSCAASGRTFSNGPMGWFRQAPGKEREFVAHISTGGATNYADSVKGRFTISADNSKNTAYLQMNSLKPEDTAVYYCASWDGRQGWGQGTLVTVSS |
| GLP1R-44-04 | 368 | EVQLVESGGGLVQPGGSLRLSCAASGRALSSYSMGWFRQAPGKEREFVALITRSGGTTFYADSVKGRFTISADNSKNTAYLQMNSLKPEDTAVYYCALDNRHSYVDWGQGTLVTVSS |
| GLP1R-44-05 | 369 | EVQLVESGGGLVQPGGSLRLSCAASGSIGSINAMGWFRQAPGKEREFVAAISWSGGATNYADSVKGRFTISADNSKNTAYLQMNSLKPEDTAVYYCAASVAYSDYDLGNDWGQGTLVTVSS |
| GLP1R-44-06 | 370 | EVQLVESGGGLVQPGGSLRLSCAASGLSFDDYAMGWFRQAPGKEREFVAAISGRSGNTYYADSVKGRFTISADNSKNTAYLQMNSLKPEDTAVYYCALIQRRAPYSRLETWGQGTLVTVSS |
| GLP1R-44-07 | 371 | EVQLVESGGGLVQPGGSLRLSCAASGFTFSIYAMGWFRQAPGKEREGVAAISWSGGTTYYADSVKGRFTISADNSKNTAYLQMNSLKPEDTAVYYCAAAAGWVAEYGYWGQGTLVTVSS |
| GLP1R-44-08 | 372 | EVQLVESGGGLVQPGGSLRLSCAASGGTFSSYAMGWFRQAPGKEREFVATISSNGNTTYYADSVKGRFTISADNSKNTAYLQMNSLKPEDTAVYYCAADLRVLRLRRYEYNYWGQGTLVTVSS |
| GLP1R-44-09 | 373 | EVQLVESGGGLVQPGGSLRLSCAASGFTFRSNAMGWFRQAPGKEREGVAAISTSGGITYYADSVKGRFTISADNSKNTAYLQMNSLKPEDTAVYYCAAERDGYGYWGQGTLVTVSS |
| GLP1R-44-10 | 374 | EVQLVESGGGLVQPGGSLRLSCAASGFTFDDYAMGWFRQAPGKERELVAGISWNGGITYYADSVKGRFTISADNSKNTAYLQMNSLKPEDTAVYYCAVVRAGYDYWGQGTLVTVSS |
| GLP1R-44-11 | 375 | EVQLVESGGGLVQPGGSLRLSCAASGSTFSIYAMGWFRQAPGKEREWVATISWSGGSTNYADSVKGRFTISADNSKNTAYLQMNSLKPEDTAVYYCAVGRSGRDYWGQGTLVTVSS |
| GLP1R-44-12 | 376 | EVQLVESGGGLVQPGGSLRLSCAASGRAFESYAMGWFRQAPGKEREFVAAIRWSGGSTYYADSVKGRFTISADNSKNTAYLQMNSLKPEDTAVYYCATGGWGTGRYNWGQGTLVTVSS |
| GLP1R-44-13 | 377 | EVQLVESGGGLVQPGGSLRLSCAASGRIFSDYAMGWFRQAPGKEREFVATINGDGDSTNYADSVKGRFTISADNSKNTAYLQMNSLKPEDTAVYYCAANTYWYYTYDSWGQGTLVTVSS |
| GLP1R-44-14 | 378 | EVQLVESGGGLVQPGGSLRLSCAASGRIFSDYAMGWFRQAPGKEREFVATINGDGDSTNYADSVKGRFTISADNSKNTAYLQMNSLKPEDTAVYYCAANTYCNYTYDSWGQGTLVTVSS |

TABLE 11-continued

GLP1R Sequences

| GLP1R Variant | SEQ ID NO | Sequence |
|---|---|---|
| GLP1R-44-15 | 379 | EVQLVESGGGLVQPGGSLRLSCAASGRTLSRSNMGWFRQAPGKEREFVAAVRWSGGITWYADSVKGRFTISADNSKNTAYLQMNSLKPEDTAVYYCALGPVRRSRLEWGQGTLVTVSS |
| GLP1R-44-16 | 380 | EVQLVESGGGLVQPGGSLRLSCAASGFTFSTYAMGWFRQAPGKEREFVAAITWSGGSTNYADSVKGRFTISADNSKNTAYLQMNSLKPEDTAVYYCAAGRAGRDSWGQGTLVTVSS |
| GLP1R-44-17 | 381 | EVQLVESGGGLVQPGGSLRLSCAASGRTFNSYAMGWFRQAPGKEREFVAGITRSAVSTSYADSVKGRFTISADNSKNTAYLQMNSLKPEDTAVYYCAAFRGIMRPDWGQGTLVTVSS |
| GLP1R-44-18 | 382 | EVQLVESGGGLVQPGGSLRLSCAASGFTFRNYVMGWFRQAPGKEREFVASITWSGGTTYYADSVKGRFTISADNSKNTAYLQMNSLKPEDTAVYYCAAGRGSGRDYWGQGTLVTVSS |
| GLP1R-44-19 | 383 | EVQLVESGGGLVQPGGSLRLSCAASGRALSSNSMGWFRQAPGKEREFVALITRSGGTTFYADSVKGRFTISADNSKNTAYLQMNSLKPEDTAVYYCALNNRRRYVDWGQGTLVTVSS |
| GLP1R-44-20 | 384 | EVQLVESGGGLVQPGGSLRLSCAASGRTFSSYAMGWFRQAPGKEREFVAAISWSGGSTYYADSVKGRFTISADNSKNTAYLQMNSLKPEDTAVYYCAVGRNGRDYWGQGTLVTVSS |
| GLP1R-44-21 | 385 | EVQLVESGGGLVQPGGSLRLSCAASGSTFSIYAMGWFRQAPGKEREFVAAISWSGGNTYYADSVKGRFTISADNSKNTAYLQMNSLKPEDTAVYYCAAVPTIAYNTGYDYWGQGTLVTVSS |
| GLP1R-44-22 | 386 | EVQLVESGGGLVQPGGSLRLSCAASGRTEDDYAMGWFRQAPGKERELVSGITWSGGSTYYADSVKGRFTISADNSKNTAYLQMNSLKPEDTAVYYCAAVLGYDGYDYWGQGTLVTVSS |
| GLP1R-44-23 | 387 | EVQLVESGGGLVQPGGSLRLSCAASGRTFSIYAMGWFRQAPGKERELVSAISTDDGSTYYADSVKGRFTISADNSKNTAYLQMNSLKPEDTAVYYCAAALPDDTYLATTYDYWGQGTLVTVSS |
| GLP1R-44-24 | 388 | EVQLVESGGGLVQPGGSLRLSCAASGSIFSDNVMGWFRQAPGKEREMVAAIRWSGGITWYADSVKGRFTISADNSKNTAYLQMNSLKPEDTAVYYCATDLSGRGDVSEYEYDWGQGTLVTVSS |
| GLP1R-44-25 | 389 | EVQLVESGGGLVQPGGSLRLSCAASGEIASIIAMGWFRQAPGKEREWVSAINSGGDTYYADSVKGRFTISADNSKNTAYLQMNSLKPEDTAVYYCAADRSRTIWPDWGQGTLVTVSS |
| GLP1R-44-26 | 390 | EVQLVESGGGLVQPGGSLRLSCAASGRTFSVSTMGWFRQAPGKEREIVAAITWSGSATYYADSVKGRFTISADNSKNTAYLQMNSLKPEDTAVYYCAAQRRWSQDWGQGTLVTVSS |
| GLP1R-44-27 | 391 | EVQLVESGGGLVQPGGSLRLSCAASGRTFSSYAMGWFRQAPGKERELVAGITGGGSSTYYADSVKGRFTISADNSKNTAYLQMNSLKPEDTAVYYCAAVTRYGYDYWGQGTLVTVSS |
| GLP1R-44-28 | 392 | EVQLVESGGGLVQPGGSLRLSCAASGIPFRSRTMGWFRQAPGKEREFVAGITRNSIRTRYADSVKGRFTISADNSKNTAYLQMNSLKPEDTAVYYCAAAPRRPYLPIRIRDYIWGQGTLVTVSS |
| GLP1R-44-29 | 393 | EVQLVESGGGLVQPGGSLRLSCAASGRTIVPYTMGWFRQAPGKEREFVAAISWSGASTIYADSVKGRFTISADNSKNTAYLQMNSLKPEDTAVYYCAIGGTLYDRRRFEWGQGTLVTVSS |
| GLP1R-44-30 | 394 | EVQLVESGGGLVQPGGSLRLSCAASGFTFSNNAMGWFRQAPGKEREGVAAINGSGSITYYADSVKGRFTISADNSKNTAYLQMNSLKPEDTAVYYCAAARDDYGYWGQGTLVTVSS |
| GLP1R-44-31 | 395 | EVQLVESGGGLVQPGGSLRLSCAASGRTFSIYGMGWFRQAPGKEREGVAGISWSDGSTSYADSVKGRFTISADNSKNTAYLQMNSLKPEDTAVYYCAAASDASFDYWGQGTLVTVSS |
| GLP1R-44-32 | 396 | EVQLVESGGGLVQPGGSLRLSCAASGGTFSDYGMGWFRQAPGKEREGVASISWNDGSTSYADSVKGRFTISADNSKNTAYLQMNSLKPEDTAVYYCAAATADYDYWGQGTLVTVSS |

TABLE 11-continued

| GLP1R Sequences | | |
|---|---|---|
| GLP1R Variant | SEQ ID NO | Sequence |
| GLP1R-44-33 | 397 | EVQLVESGGGLVQPGGSLRLSCAASGSTFSTYAMGWFRQAPGKERELVAAISWSSGTTYYADSVKGRFTISADNSKNTAYLQMNSLKPEDTAVYYCAAVLVTSDGVSEYNYWGQGTLVTVSS |
| GLP1R-44-34 | 398 | EVQLVESGGGLVQPGGSLRLSCAASGFLFDSYAMGWFRQAPGKEREPVAAISPAALTTYYADSVKGRFTISADNSKNTAYLQMNSLKPEDTAVYYCAAYYTDYDEALEETRGSYDWGQGTLVTVSS |
| GLP1R-44-35 | 399 | EVQLVESGGGLVQPGGSLRLSCAASGFTLSNYAMGWFRQAPGKEREGVAAISWNSGSTYYADSVKGRFTISADNSKNTAYLQMNSLKPEDTAVYYCATDARRYGYWGQGTLVTVSS |
| GLP1R-44-36 | 400 | EVQLVESGGGLVQPGGSLRLSCAASGSTFGNYAMGWFRQAPGKEREFVAAISRSGSITYYADSVKGRFTISADNSKNTAYLQMNSLKPEDTAVYYCATDEDYALGPNEYDWGQGTLVTVSS |
| GLP1R-44-37 | 401 | EVQLVESGGGLVQPGGSLRLSCAASGRTFSIYAMGWFRQAPGKERELVAGISWGGDSTYYADSVKGRFTISADNSKNTAYLQMNSLKPEDTAVYYCAAVAGNGYDYWGQGTLVTVSS |
| GLP1R-44-38 | 402 | EVQLVESGGGLVQPGGSLRLSCAASGFNSGSYTMGWFRQAPGKEREGVSYISSSDGRTYYADSVKGRFTISADNSKNTAYLQMNSLKPEDTAVYYCAAALDGYSGSWGQGTLVTVSS |
| GLP1R-44-39 | 403 | EVQLVESGGGLVQPGGSLRLSCAASGLTFWTSGMGWFRQAPGKEREYVAAISRSGSLKGYADSVKGRFTISADNSKNTAYLQMNSLKPEDTAVYYCATVATALIWGQGTLVTVSS |
| GLP1R-44-40 | 404 | EVQLVESGGGLVQPGGSLRLSCAASGFTFSINAMGWFRQAPGKERELVSGISWGGGSTYYADSVKGRFTISADNSKNTAYLQMNSLKPEDTAVYYCAAVNEDGFDYWGQGTLVTVSS |
| GLP1R-44-41 | 405 | EVQLVESGGGLVQPGGSLRLSCAASGFTFDDNAMGWFRQAPGKERELVAAISTSGSNTYYADSVKGRFTISADNSKNTAYLQMNSLKPEDTAVYYCAAELREYGYWGQGTLVTVSS |
| GLP1R-44-42 | 406 | EVQLVESGGGLVQPGGSLRLSCAASGRTFTSYNMGWFRQAPGKEREFLGSILWSDDSTNYADSVKGRFTISADNSKNTAYLQMNSLKPEDTAVYYCASWDGRQVWGQGTLVTVSS |
| GLP1R-44-43 | 407 | EVQLVESGGGLVQPGGSLRLSCAASGFTFRNYVMGWFRQAPGKEREFVAAINWNGSITYYADSVKGRFTISADNSKNTAYLQMNSLKPEDTAVYYCAAGRSARNYWGQGTLVTVSS |
| GLP1R-44-44 | 408 | EVQLVESGGGLVQPGGSLRLSCAASGRTFSSYAMGWFRQAPGKEREFVAAISTSGGITYYADSVKGRFTISADNSKNTAYLQMNSLKPEDTAVYYCATDRIEYSRGGYDYWGQGTLVTVSS |
| GLP1R-44-45 | 409 | EVQLVESGGGLVQPGGSLRLSCAASGSTFRKYAMGWFRQAPGKEREFVAAISSGGGSTNYADSVKGRFTISADNSKNTAYLQMNSLKPEDTAVYYCAAGRYRERDSWGQGTLVTVSS |
| GLP1R-44-46 | 410 | EVQLVESGGGLVQPGGSLRLSCAASGSTFSIYAMGWFRQAPGKEREFVAAISWSGDTTYYADSVKGRFTISADNSKNTAYLQMNSLKPEDTAVYYCAIDLPDDTYLATEYDYWGQGTLVTVSS |
| GLP1R-44-47 | 411 | EVQLVESGGGLVQPGGSLRLSCAASGSGFSPNVMGWFRQAPGKERELVAIKFSGGTTDYADSVKGRFTISADNSKNTAYLQMNSLKPEDTAVYYCAAIAYEEGVYRWDWGQGTLVTVSS |
| GLP1R-44-48 | 412 | EVQLVESGGGLVQPGGSLRLSCAASGRTLTNHDMGWFRQAPGKEREGVSYISMSDGRTYYADSVKGRFTISADNSKNTAYLQMNSLKPEDTAVYYCAAVLDGYSGSWGQGTLVTVSS |
| GLP1R-44-49 | 413 | EVQLVESGGGLVQPGGSLRLSCAASGSTFSIYAMGWFRQAPGKEREFVAAISRSGDSTYYADSVKGRFTISADNSKNTAYLQMNSLKPEDTAVYYCAAVTLDNYGYWGQGTLVTVSS |
| GLP1R-44-50 | 414 | EVQLVESGGGLVQPGGSLRLSCAASGGTASSYHMGWFRQAPGKEREFVAFIHRSGTSTYYADSVKGRFTISADNSKNTAYLQMNSLKPEDTAVYYCAADSITDRRSVAVAHTSYYWGQGTLVTVSS |
| GLP1R-44-51 | 415 | EVQLVESGGGLVQPGGSLRLSCAASGLTFSTYAMGWFRQAPGKEREIVAAITWSGGITYYADSVKGRFTISADNSKNTAYLQMNSLKPEDTAVYYCAAHGSILLDRIEWGQGTLVTVSS |

TABLE 11-continued

GLP1R Sequences

| GLP1R Variant | SEQ ID NO | Sequence |
|---|---|---|
| GLP1R-44-52 | 416 | EVQLVESGGGLVQPGGSLRLSCAASGGTFSIYAMGWFRQAPGKERELVAAISSSGSITYYADSVKGRFTISADNSKNTAYLQMNSLKPEDTAVYYCAAAAALDGPGDMYDYWGQGTLVTVSS |
| GLP1R-44-53 | 417 | EVQLVESGGGLVQPGGSLRLSCAASGGTFDNYAMGWFRQAPGKERELVSGINSDGGSTYYADSVKGRFTISADNSKNTAYLQMNSLKPEDTAVYYCAAVPISSPSDRNYWGQGTLVTVSS |
| GLP1R-44-54 | 418 | EVQLVESGGGLVQPGGSLRLSCAASGRTFSLTAMGWFRQAPGKEREFVAAISPAALTTYYADSVKGRFTISADNSKNTAYLQMNSLKPEDTAVYYCASRRAFRLSSDYEWGQGTLVTVSS |
| GLP1R-44-55 | 419 | EVQLVESGGGLVQPGGSLRLSCAASGRNLRMYRMGWFRQAPGKEREFVAAVNWNGDSTYYADSVKGRFTISADNSKNTAYLQMNSLKPEDTAVYYCAANWKMLLGVENDWGQGTLVTVSS |
| GLP1R-44-56 | 420 | EVQLVESGGGLVQPGGSLRLSCAASGFTFDIYAMGWFRQAPGKERELVAGISSSGGSTYYADSVKGRFTISADNSKNTAYLQMNSLKPEDTAVYYCAAVLGTYDYWGQGTLVTVSS |
| GLP1R-44-57 | 421 | EVQLVESGGGLVQPGGSLRLSCAASGRTFDIYAMGWFRQAPGKERELVAAINRDDSSTYYADSVKGRFTISADNSKNTAYLQMNSLKPEDTAVYYCAAVAGLGNYNYWGQGTLVTVSS |
| GLP1R-44-58 | 422 | EVQLVESGGGLVQPGGSLRLSCAASGRSFSFNAMGWFRQAPGKERELVAAITKLGFRNYADSVKGRFTISADNSKNTAYLQMNSLKPEDTAVYYCAASIEGVSGRWGQGTLVTVSS |
| GLP1R-44-59 | 423 | EVQLVESGGGLVQPGGSLRLSCAASGSFFSINAMGWFRQAPGKERELVSASTWNGGYTYYADSVKGRFTISADNSKNTAYLQMNSLKPEDTAVYYCAAHRIVVGGTSVGDWRWGQGTLVTVSS |
| GLP1R-44-60 | 424 | EVQLVESGGGLVQPGGSLRLSCAASGRTFSDYAMGWFRQAPGKEREFVAGITSSGGYTYYADSVKGRFTISADNSKNTAYLQMNSLKPEDTAVYYCAAVVYYGDWEGSEPVQHEYDWGQGTLVTVSS |
| GLP1R-44-61 | 425 | EVQLVESGGGLVQPGGSLRLSCAASGSIFSRNAMGWFRQAPGKEREFVAAIRWSGKETWYADSVKGRFTISADNSKNTAYLQMNSLKPEDTAVYYCAKTKRTGIFTTARMVDWGQGTLVTVSS |
| GLP1R-44-62 | 426 | EVQLVESGGGLVQPGGSLRLSCAASGGTFDTYAMGWFRQAPGKEREFVAGISGDGTITYYADSVKGRFTISADNSKNTAYLQMNSLKPEDTAVYYCATDNPYWSGYNYWGQGTLVTVSS |
| GLP1R-44-63 | 427 | EVQLVESGGGLVQPGGSLRLSCAASGGTFSNYAMGWFRQAPGKERELVSGINSDGGSTYYADSVKGRFTISADNSKNTAYLQMNSLKPEDTAVYYCAAVSTNDGYDYWGQGTLVTVSS |
| GLP1R-44-64 | 428 | EVQLVESGGGLVQPGGSLRLSCAASGGIYRVNTMGWFRQAPGKERELVAIKFSGGTTDYADSVKGRFTISADNSKNTAYLQMNSLKPEDTAVYYCAAIAHEEGVYRWDWGQGTLVTVSS |
| GLP1R-44-65 | 429 | EVQLVESGGGLVQPGGSLRLSCAASGFTFSTYAMGWFRQAPGKERELVAGISSSGSSTYYADSVKGRFTISADNSKNTAYLQMNSLKPEDTAVYYCAVVSDGGYDYWGQGTLVTVSS |
| GLP1R-44-66 | 430 | EVQLVESGGGLVQPGGSLRLSCAASGRTSSIYNMGWFRQAPGKEREFVAAISRSGRSTSYADSVKGRFTISADNSKNTAYLQMNSLKPEDTAVYYCAAIVTYSDYDLGNDWGQGTLVTVSS |
| GLP1R-44-67 | 431 | EVQLVESGGGLVQPGGSLRLSCAASGRALSSYSMGWFRQAPGKEREFVALITRSGGTTFYADSVKGRFTISADNSKNTAYLQMNSLKPEDTAVYYCALDNRRSYVDWGQGTLVTVSS |
| GLP1R-44-68 | 432 | EVQLVESGGGLVQPGGSLRLSCAASGRALSRYGMVWFRQAPGKEREFVAAINRGGKISHYADSVKGRFTISADNSKNTAYLQMNSLKPEDTAVYYCAAGNGGRNYGHSRARYEWGQGTLVTVSS |
| GLP1R-44-69 | 433 | EVQLVESGGGLVQPGGSLRLSCAASGFKFNDSYMRWFRQAPGKEREFVVAINWSSGSTYYADSVKGRFTISADNSKNTAYLQMNSLKPEDTAVYYCAVVNGPIFWGQGTLVTVSS |

TABLE 11-continued

| GLP1R Sequences | | |
|---|---|---|
| GLP1R Variant | SEQ ID NO | Sequence |
| GLP1R-44-70 | 434 | EVQLVESGGGLVQPGGSLRLSCAASGRTLSDYALGWFRQAPGKERELVSGINTSGDTTYYADSVKGRFTISADNSKNTAYLQMNSLKPEDTAVYYCAVVTSSYDYWGQGTLVTVSS |
| GLP1R-44-71 | 435 | EVQLVESGGGLVQPGGSLRLSCAASGSTFDIYGMGWFRQAPGKEREGVAAITGDGSSTSYADSVKGRFTISADNSKNTAYLQMNSLKPEDTAVYYCAADNDTEYGYWGQGTLVTVSS |
| GLP1R-44-72 | 436 | EVQLVESGGGLVQPGGSLRLSCAASGGTLDIYAMGWFRQAPGKEREFVAAISWSGSTTYYADSVKGRFTISADNSKNTAYLQMNSLKPEDTAVYYCAAVLGYDRDYWGQGTLVTVSS |
| GLP1R-44-73 | 437 | EVQLVESGGGLVQPGGSLRLSCAASGRPYSYDAMGWFRQAPGKEREIVAAISRTGSSIYYADSVKGRFTISADNSKNTAYLQMNSLKPEDTAVYYCAAQGSLYDDYDGLPIKYDWGQGTLVTVSS |
| GLP1R-44-74 | 438 | EVQLVESGGGLVQPGGSLRLSCAASGRTFRTYGMGWFRQAPGKEREGVAAISWSGNSTSYADSVKGRFTISADNSKNTAYLQMNSLKPEDTAVYYCAARLSKRGNRSSRDYWGQGTLVTVSS |
| GLP1R-44-75 | 439 | EVQLVESGGGLVQPGGSLRLSCAASGSTFDNYAMGWFRQAPGKERELVAGINWSDSSTYYADSVKGRFTISADNSKNTAYLQMNSLKPEDTAVYYCAAVAGWGEYDYWGQGTLVTVSS |
| GLP1R-44-76 | 440 | EVQLVESGGGLVQPGGSLRLSCAASGSTFSIYAMGWFRQAPGKERELVAGINWSDSSTYYADSVKGRFTISADNSKNTAYLQMNSLKPEDTAVYYCAAVTDYDEYNYWGQGTLVTVSS |

TABLE 12

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R-3 | 441 | GFTFSSYG | 620 | ISYDESNK | 799 | AKHMSMQEGAVTGEGQAAKEFIAWLVKGRVRADLVGDAFDV |
| GLP1R221-065 | 442 | GFTFSDYG | 621 | ISYDRSNE | 800 | AKHMSMQEGAVTGDGQAAKEFIAWLVKGRVRADLVGDAFDV |
| GLP1R221-075 | 443 | GFTFSDYG | 622 | ISYDETNK | 801 | AKHMSMQEGAVTGEGQAAKEFIAWLVKGIVRADLVGDAFDV |
| GLP1R221-017 | 444 | GFTFSDYG | 623 | ISYDESNK | 802 | AKHMSMQEGAVTGEYQAAKEFIAWLVKGRVRADLVGDAFDV |
| GLP1R221-033 | 445 | GFTFSDYG | 624 | ISHDRSNK | 803 | AKHMSMQEGAVTGEGQAAKDFIAWLVKGRVRADLVGDAFDV |
| GLP1R221-076 | 446 | GFTFSDYG | 625 | ISYDETNK | 804 | AKHMSMQEGAVTGEGQAAKEFIAWLVKGIVRADLVGDAFDV |
| GLP1R221-092 | 447 | GFTFSDYG | 626 | ISYGGSNK | 805 | AKHMSMQEGAVTGEGQAVKEFIAWLVKGRVRADLVGDAFDV |
| GLP1R221-034 | 448 | GFTFSDYG | 627 | ISHDRSNK | 806 | AKHMSMQEGAVTGEGQAVKEFIAWLVKGRVRADLVGDAFDV |
| GLP1R221-066 | 449 | GFTFSDYG | 628 | ISYDRSNE | 807 | AKHMSMQEGAVTGEGQAIKEFIAWLVKGRVRADLVGDAFDV |

TABLE 12-continued

Variable Heavy Chain CDRs

| Variant | SEQ ID NO | CDR1 | SEQ ID NO | CDR2 | SEQ ID NO | CDR3 |
|---|---|---|---|---|---|---|
| GLP1R221-084 | 450 | GFTFSDYG | 629 | ISSDENNK | 808 | AKHMSMQEGAVTGEMQAAKEFIAWLVKGRVRADLVGDAFDV |
| GLP1R221-009 | 451 | GFTFSDYG | 630 | ISDEGSNK | 809 | AKHMSMQEGAVTGAGQAAKEFIAWLVKGRVRADLVGDAFDV |
| GLP1R221-072 | 452 | GFTFSDYG | 631 | ISSDENNK | 810 | AKHMSMQEGAVTGEFQAAKEFIAWLVKGRVRADLVGDAFDV |
| GLP1R221-044 | 453 | GFTFSDYG | 632 | TSYDESNK | 811 | AKHMSMQEGAVTGEYQAAKEFIAWLVKGRVRADLVGDAFDV |
| GLP1R221-012 | 454 | GFTFSDYG | 633 | ISSDASDK | 812 | AKHMSMQEGAVTGEYQAAKEFIAWLVKGRVRADLVGDAFDV |
| GLP1R221-042 | 455 | GFTFSDYG | 634 | TSYDESNK | 813 | AKHMSMQEGAVTGVGQAAKEFIAWLVKGRVRADLVGDAFDV |
| GLP1R221-051 | 456 | GFTFSDYG | 635 | ISYEGSNK | 814 | AKHMSMQEGAVTGMGQAAKEFIAWLIKGRVRADLVGDAFDV |
| GLP1R221-083 | 457 | GFTFSDYG | 636 | ISSDASDK | 815 | AKHMSMQEGAVTGMGQAAKEFIAWLVKGRVRADLVGDAFDV |
| GLP1R221-040 | 458 | GFTFSDYG | 637 | ISYDESNE | 816 | AKHMSMQEGAVTGEHQAAKEFIAWLVKGRVRADLVGDAFDV |
| GLP1R221-052 | 459 | GFTFSDYG | 638 | ISYDRSNE | 817 | AKHMSMQEGAVHGEGQAAKEFIAWLVKGRVRADLVGDAFDV |
| GLP1R221-003 | 460 | GFTFSDYG | 639 | ISDEGSNK | 818 | AKHMSMQEGAVTGEWQAAKEFIAWLVKGRVRADLVGDAFDV |
| GLP1R221-094 | 461 | GFTFSDYG | 640 | ISSDENNK | 819 | AKHMSMQEGAVTGEFQAAKEFIAWLVKGRVRADLVGDAFDV |
| GLP1R221-001 | 462 | GFTFSDYG | 641 | ISYDASNK | 820 | AKHMSMQEGAVTGEGQAVKEFIAWLVKGRVRADLVGDAFDV |
| GLP1R221-014 | 463 | GFTFSDYG | 642 | ISSDASDK | 821 | AKHMSMQEGAVTGEWQAAKEFIAWLVKGRVRADLVGDAFDV |
| GLP1R221-085 | 464 | GFTFSDYG | 643 | ISHDRSNK | 822 | AKHMSMQEGAVTGLGQAAKEFIAWLVKGRVRADLVGDAFDV |
| GLP1R221-022 | 465 | GFTFSDYG | 644 | ISYDANNK | 823 | AKHMSMQEGAVTGEGQAAKEFIAWLIKGRVRADLVGDAFDV |
| GLP1R221-056 | 466 | GFTFSDYG | 645 | ISYEGSNQ | 824 | AKHMSMQEGAVTGIGQAAKEFIAWLVKGRVRADLVGDAFDV |
| GLP1R221-088 | 467 | GFTFSDYG | 646 | TSYDESNK | 825 | AKHMSMQEGAVTGFGQAAKEFIAWLVKGRVRADLVGDAFDV |
| GLP1R221-077 | 468 | GFTFSDYG | 647 | ISYDATNK | 826 | AKHMSMQEGAVTGMGQAAKEFIAWLVKGRVRADLVGDAFDV |

TABLE 12-continued

Variable Heavy Chain CDRs

| Variant | SEQ ID NO | CDR1 | SEQ ID NO | CDR2 | SEQ ID NO | CDR3 |
|---|---|---|---|---|---|---|
| GLP1R221-027 | 469 | GFTFSDYG | 648 | ISYHGSNK | 827 | AKHMSMQEGAVTGMGQAAKEFIAWLVKGRVRADLVGDAFDV |
| GLP1R221-019 | 470 | GFTFSDYG | 649 | ISYDASNK | 828 | AKHMSMQEGAVTGYGQAAKEFIAWLVKGRVRADLVGDAFDV |
| GLP1R221-029 | 471 | GFTFSDYG | 650 | ISSDASDK | 829 | AKHMSMQEGAVTGEFQAAKEFIAWLVKGRVRADLVGDAFDV |
| GLP1R221-043 | 472 | GFTFSDYG | 651 | TSYDESNK | 830 | AKHMSMQEGAVTGGGQAAKEFIAWLVKGRVRADLVGDAFDV |
| GLP1R221-082 | 473 | GFTFSDYG | 652 | ISSDASNK | 831 | AKHMSMQEGAVTGEGQAVKEFIAWLVKGRVRADLVGDAFDV |
| GLP1R221-079 | 474 | GFTFSDYG | 653 | ISYDANNK | 832 | AKHMSMQEGAVTGEWQAAKEFIAWLVKGRVRADLVGDAFDV |
| GLP1R221-080 | 475 | GFTFSDYG | 654 | ISHDRSNK | 833 | AKHMSMQEGAVTGPGQAAKEFIAWLVKGRVRADLVGDAFDV |
| GLP1R221-059 | 476 | GFTFSDYG | 655 | IRYGGSNK | 834 | AKHMSMQEGAVTGEGQAAKEFIAWLVKGRVRADLVGDAFDV |
| GLP1R221-069 | 477 | GFTFSDYG | 656 | ISYDATNK | 835 | AKHMSMQEGAVTGYGQAAKEFIAWLVKGRVRADLVGDAFDV |
| GLP1R221-036 | 478 | GFTFSDYG | 657 | ISDEGSNK | 836 | AKHMSMQEGAVTGMGQAAKEFIAWLVKGRVRADLVGDAFDV |
| GLP1R221-057 | 479 | GFTFSDYG | 658 | ISYEGSNQ | 837 | AKHMSMQEGAVTGWGQAAKEFIAWLVKGRVRADLVGDAFDV |
| GLP1R221-035 | 480 | GFTFSDYG | 659 | ISDEGSNK | 838 | AKHMSMQEGAVTGLGQAAKEFIAWLVKGRVRADLVGDAFDV |
| GLP1R221-063 | 481 | GFTFSDYG | 660 | ISDEGSNK | 839 | AKHMSMQEGAVTGEWQAAKEFIAWLVKGRVRADLVGDAFDV |
| GLP1R221-090 | 482 | GFTFSDYG | 661 | TSYDESNK | 840 | AKHMSMQEGAVTGEWQAAKEFIAWLVKGRVRADLVGDAFDV |
| GLP1R221-002 | 483 | GFTFSDYG | 662 | ISSDASHK | 841 | AKHMSMQEGAVTWEGQAAKEFIAWLVKGRVRADLVGDAFDV |
| GLP1R221-087 | 484 | GFTFSDYG | 663 | ISYDETNK | 842 | AKHMSMQEGAVTGFGQAAKEFIAWLVKGRVRADLVGDAFDV |
| GLP1R221-038 | 485 | GFTFSDYG | 664 | ISDEGSNK | 843 | AKHMSMQEGAVTGMGQAAKEFIAWLVKGRVRADLVGDAFDV |
| GLP1R221-060 | 486 | GFTFSDYG | 665 | ISYGGSNK | 844 | AKHMSMQEGAVTNEGQAAKEFIAWLVKGRVRADLVGDAFDV |

TABLE 12-continued

Variable Heavy Chain CDRs

| Variant | SEQ ID NO | CDR1 | SEQ ID NO | CDR2 | SEQ ID NO | CDR3 |
|---|---|---|---|---|---|---|
| GLP1R221-015 | 487 | GFTFSDYG | 666 | ISSDASHK | 845 | AKHMSMQEGAVTWEGQAAKEFIAWLVKGRVRADLVGDAFDV |
| GLP1R221-020 | 488 | GFTFSDYG | 667 | ISYDESNK | 846 | AKHMSMQEGAVTGEWQAAKEFIAWLVKGRVRADLVGDAFDV |
| GLP1R221-011 | 489 | GFTFSDYG | 668 | ISSDASDK | 847 | AKHMSMQEGAVTGGGQAAKEFIAWLVKGRVRADLVGDAFDV |
| GLP1R221-091 | 490 | GFTFSDYG | 669 | ISYGGSNK | 848 | AKHMSMQEGAVTGEWQAAKEFIAWLVKGRVRADLVGDAFDV |
| GLP1R221-086 | 491 | GFTFSDYG | 670 | TSYDESNK | 849 | AKHMSMQEGAVTGEWQAAKEFIAWLVKGRVRADLVGDAFDV |
| GLP1R221-074 | 492 | GFTFSDYG | 671 | ISHDRSNK | 850 | AKHMSMQEGAVTGEGQALKEFIAWLVKGRVRADLVGDAFDV |
| GLP1R221-032 | 493 | GFTFSDYG | 672 | ISHDRSNK | 851 | AKHMSMQEGAVTGEGQAAKDFIAWLVKGRVRADLVGDAFDV |
| GLP1R221-013 | 494 | GFTFSDYG | 673 | ISSDASDK | 852 | AKHMSMQEGAVTGWGQAAKEFIAWLVKGRVRADLVGDAFDV |
| GLP1R221-058 | 495 | GFTFSDYG | 674 | ISHDRSNK | 853 | AKHMSMQEGAVTGWGQAAKEFIAWLVKGRVRADLVGDAFDV |
| GLP1R221-031 | 496 | GFTFSDYG | 675 | ISSDASDK | 854 | AKHMSMQEGAVTGEGQALKEFIAWLVKGRVRADLVGDAFDV |
| GLP1R221-054 | 497 | GFTFSDYG | 676 | ISSDASDK | 855 | AKHMSMQEGAVTGEGWAAKEFIAWLVKGRVRADLVGDAFDV |
| GLP1R221-021 | 498 | GFTFSDYG | 677 | ISYDATNK | 856 | AKHMSMQEGAVTGEGQFAKEFIAWLVKGRVRADLVGDAFDV |
| GLP1R221-016 | 499 | GFTFSDYG | 678 | ISSDASHK | 857 | AKHMSMQEGAVTWEGQAAKEFIAWLVKGRVRADLVGDAFDV |
| GLP1R221-030 | 500 | GFTFSDYG | 679 | ISSDASDK | 858 | AKHMSMQEGAVTGEGQALKEFIAWLVKGRVRADLVGDAFDV |
| GLP1R221-018 | 501 | GFTFSDYG | 680 | ISSDASDK | 859 | AKHMSMQEGAVTGEWQAAKEFIAWLVKGRVRADLVGDAFDV |
| GLP1R221-028 | 502 | GFTFSDYG | 681 | ISYDAGNK | 860 | AKHMSMQEGAVTGMGQAAKEFIAWLVKGRVRADLVGDAFDV |
| GLP1R221-023 | 503 | GFTFSDYG | 682 | TSYEESNK | 861 | AKHMSMQEGAVTGMGQAAKEFIAWLVKGRVRADLVGDAFDV |
| GLP1R221-089 | 504 | GFTFSDYG | 683 | ISHDRSNK | 862 | AKHMSMQEGAVTGIGQAAKEFIAWLVKGRVRADLVGDAFDV |
| GLP1R221-053 | 505 | GFTFSDYG | 684 | ISSDASDK | 863 | AKHMSMQEGAVTGWGQAAKEFIAWLVKGRVRADLVGDAFDV |

TABLE 12-continued

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R221-071 | 506 | GFTFSDYG | 685 | ISSDENNK | 864 | AKHMSMQEGAVTGIGQAAKEFIAWLVKGRVRADLVGDAFDV |
| GLP1R221-055 | 507 | GFTFSDYG | 686 | ISYGGSNK | 865 | AKHMSMQEGAVTGWGQAAKEFIAWLVKGRVRADLVGDAFDV |
| GLP1R221-046 | 508 | GFTFSDYG | 687 | ISSDASNK | 866 | AKHMSMQEGAVTGMGQAAKEFIAWLVKGRVRADLVGDAFDV |
| GLP1R221-039 | 509 | GFTFSDYG | 688 | IRYDESNK | 867 | AKHMSMQEGAVTGEGQALKEFIAWLVKGRVRADLVGDAFDV |
| GLP1R221-078 | 510 | GFTFSDYG | 689 | ISSDASNK | 868 | AKHMSMQEGAVMGEGQAAKEFIAWLVKGRVRADLVGDAFDV |
| GLP1R221-010 | 511 | GFTFSDYG | 690 | ISSDASDK | 869 | AKHMSMQEGAVTGIGQAAKEFIAWLVKGRVRADLVGDAFDV |
| GLP1R221-005 | 512 | GFTFSDYG | 691 | ISDEGSNK | 870 | AKHMSMQEGAVTGLGQAAKEFIAWLVKGRVRADLVGDAFDV |
| GLP1R221-073 | 513 | GFTFSDYG | 692 | ISHDRSNK | 871 | AKHMSMQEGAVTGFGQAAKEFIAWLVKGRVRADLVGDAFDV |
| GLP1R221-041 | 514 | GFTFSDYG | 693 | ISYDETNK | 872 | AKHMSMQEGAVTGIGQAAKEFIAWLVKGRVRADLVGDAFDV |
| GLP1R221-025 | 515 | GFTFSDYG | 694 | ISYDESNK | 873 | AKHMSMQEGAVTEEGQAAKEFIAWLVKGRVRADLVGDAFDV |
| GLP1R221-007 | 516 | GFTFSDYG | 695 | ISDEGSNK | 874 | AKHMSMQEGAVTGWGQAAKEFIAWLVKGRVRADLVGDAFDV |
| GLP1R221-093 | 517 | GFTFSDYG | 696 | ISYDESNK | 875 | AKHMSMQEGAVTGFGQAAKEFIAWLVKGRVRADLVGDAFDV |
| GLP1R221-024 | 518 | GFTFSDYG | 697 | ISYDAGNK | 876 | AKHMSMQEGAVTGEGQAVKEFIAWLVKGDVRADLVGDAFDV |
| GLP1R221-008 | 519 | GFTFSDYG | 698 | ISDEGSNK | 877 | AKHMSMQEGAVTGLGQAAKEFIAWLVKGRVRADLVGDAFDV |
| GLP1R221-050 | 520 | GFTFSDYG | 699 | ISYDENNK | 878 | AKHMSMQEGAVTGMGQAAKEFIAWLVKGRVRADLVGDAFDV |
| GLP1R221-062 | 521 | GFTFSDYG | 700 | TSYDESNK | 879 | AKHMSMQEGAVTGWGQAAKEFIAWLVKGRVRADLVGDAFDV |
| GLP1R221-068 | 522 | GFTFSDYG | 701 | ISYDAGNK | 880 | AKHMSMQEGAVTGFGQAAKEFIAWLVKGRVRADLVGDAFDV |
| GLP1R221-067 | 523 | GFTFSDYG | 702 | ISNDENNK | 881 | AKHMSMQEGAVTGFGQAAKEFIAWLVKGRVRADLVGDAFDV |

TABLE 12-continued

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R221-061 | 524 | GFTFSDYG | 703 | TSYDESNK | 882 | AKHMSMQEGAVTGWGQAAKEFIAWLVKGRVRADLVGDAFDV |
| GLP1R221-064 | 525 | GFTFSDYG | 704 | ISDEGSNK | 883 | AKHMSMQEGAVTGYGQAAKEFIAWLVKGRVRADLVGDAFDV |
| GLP1R221-070 | 526 | GFTFSDYG | 705 | ISYDATNK | 884 | AKHMSMQEGAVTGIGQAAKEFIAWLVKGRVRADLVGDAFDV |
| GLP1R221-006 | 527 | GFTFSDYG | 706 | ISDEGSNK | 885 | AKHMSMQEGAVTGFGQAAKEFIAWLVKGRVRADLVGDAFDV |
| GLP1R221-045 | 528 | GFTFSDYG | 707 | ISSDASNK | 886 | AKHMSMQEGAVTGEGQAAKEFIAWLVFGRVRADLVGDAFDV |
| GLP1R221-004 | 529 | GFTFSDYG | 708 | ISDEGSNK | 887 | AKHMSMQEGAVTGFGQAAKEFIAWLVKGRVRADLVGDAFDV |
| GLP1R221-047 | 530 | GFTFSDYG | 709 | ISSDASDK | 888 | AKHMSMQEGAVTGEGQAWKEFIAWLVKGRVRADLVGDAFDV |
| GLP1R221-048 | 531 | GFTFSDYG | 710 | ISSDASDK | 889 | AKHMSMQEGAVTGEYQAAKEFIAWLVKGRVRADLVGDAFDV |
| GLP1R-222-052 | 532 | GFTFNNYP | 711 | ISYDESNK | 890 | AKHMSMQEGAVTGGGQAAKEFIAWLVKGRVRADLVGDAFDV |
| GLP1R-222-016 | 533 | GFTFNNYA | 712 | ISDEGSNK | 891 | AKHMSMQEGAVTGEYQAAKEFIAWLVKGRVRADLVGDAFDV |
| GLP1R-222-023 | 534 | GFSFSDYG | 713 | ISYDANNK | 892 | AKHMSMQEGAVTGEWQAAKEFIAWLVKGRVRADLVGDAFDV |
| GLP1R-222-014 | 535 | GFAFSNYG | 714 | ISYDESNK | 893 | AKHMSMQEGAVTGEWQAAKEFIAWLVKGRVRADLVGDAFDV |
| GLP1R-222-090 | 536 | GFSFSDYG | 715 | ISYEGSNK | 894 | AKHMSMQEGAVTGEKQAAKEFIAWLVKGRVRADLVGDAFDV |
| GLP1R-222-073 | 537 | GFTFRDYG | 716 | IRYDEINK | 895 | AKHMSMQEGAVTGEGQAAKEFIAWLVGGRVRADLVGDAFDV |
| GLP1R-222-012 | 538 | GFTFNNYG | 717 | ISDEGSNK | 896 | AKHMSMQEGAVTGVGQAAKEFIAWLVKGRVRADLVGDAFDV |
| GLP1R-222-082 | 539 | GFTFSAYS | 718 | ISYDATNK | 897 | AKHMSMQEGAVTGEFQAAKEFIAWLVKGRVRADLVGDAFDV |
| GLP1R-222-081 | 540 | GFTFDNYA | 719 | ISYDAGNK | 898 | AKHMSMQEGAVTGEGQAAKEFIAWLVKGFVRADLVGDAFDV |
| GLP1R-222-056 | 541 | GFPFSSYA | 720 | ISYDRSNK | 899 | AKHMSMQEGAVTGYGQAAKEFIAWLVKGFVRADLVGDAFDV |
| GLP1R-222-058 | 542 | GFTFRDYA | 721 | ISFDESNK | 900 | AKHMSMQEGAVTGEWQAAKEFIAWLVKGRVRADLVGDAFDV |

TABLE 12-continued

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-063 | 543 | GFTFNNYP | 722 | ISHDRSNK | 901 | AKHMSMQEGAVTGTGQAAKEFIAWLVKGIVRADLVGDAFDV |
| GLP1R-222-042 | 544 | GLTFSNYA | 723 | TSYDESNK | 902 | AKHMSMQEGAVTREGQAAKEFIAWLVKGRVRADLVGDAFDV |
| GLP1R-222-092 | 545 | GFTFGSYA | 724 | TSYDESNK | 903 | AKHMSMQEGAVTGEGQAAKEFIAWLVMGRVRADLVGDAFDV |
| GLP1R-222-007 | 546 | GFTFSSYG | 725 | ISSDASDK | 904 | AKHMSMQEGAVTGEGQAAKEFIAWLVKGWVRADLVGDAFDV |
| GLP1R-222-008 | 547 | GFNFNNYG | 726 | ISYDASNK | 905 | AKHMSMQEGAVTGEFQAAKEFIAWLVKGRVRADLVGDAFDV |
| GLP1R-222-024 | 548 | GFTSSSYA | 727 | ISDEGSNK | 906 | AKHMSMQEGAVTGEGQAAKEFIAWLVKGRVRADLVGDAFDV |
| GLP1R-222-062 | 549 | GFTFSDYP | 728 | ISYDESNK | 907 | AKHMSMQEGAVTGEGQAAKEFIAWLVKGRVRNDLVGDAFDV |
| GLP1R-222-077 | 550 | GFTFGNYG | 729 | ISYDASNK | 908 | AKHMSMQEGAVTGEFQAAKEFIAWLVKGRVRADLVGDAFDV |
| GLP1R-222-064 | 551 | GFTFNNYA | 730 | ISYAGSNE | 909 | AKHMSMQEGAVTGEGQALKEFIAWLVKGRVRADLVGDAFDV |
| GLP1R-222-074 | 552 | GFSFRSYG | 731 | ISSDASNK | 910 | AKHMSMQEGAQTGEGQAAKEFIAWLVKGRVRADLVGDAFDV |
| GLP1R-222-029 | 553 | GFSFSNYA | 732 | TSYDESNK | 911 | AKHMSMQEGAVTGEGQAAKEFIAWLLKGRVRADLVGDAFDV |
| GLP1R-222-046 | 554 | GFAFSSYA | 733 | ISYDENNK | 912 | AKHMSMQEGAVTGYGQAAKEFIAWLVKGRVRADLVGDAFDV |
| GLP1R-222-005 | 555 | GFTFNNYP | 734 | IWSDASQK | 913 | AKHMSMQEGAVTGEGWAAKEFIAWLVKGRVRADLVGDAFDV |
| GLP1R-222-004 | 556 | GFTFGNYA | 735 | ISSDASDK | 914 | AKHMSMQEGAVTGEWQAAKEFIAWLVKGRVRADLVGDAFDV |
| GLP1R-222-022 | 557 | GFAFSNYG | 736 | ISYDASNK | 915 | AKHMSMQEGAVTGEGQAAKNFIAWLVKGRVRADLVGDAFDV |
| GLP1R-222-087 | 558 | GFTFSNYA | 737 | ISYDASNK | 916 | AKHMSMQEGAVTGYGQAAKEFIAWLVKGRVRADLVGDAFDV |
| GLP1R-222-048 | 559 | GFSFGSYA | 738 | TSYDESNK | 917 | AKHMSMQEGAVTGEWQAAKEFIAWLVKGRVRADLVGDAFDV |
| GLP1R-222-072 | 560 | GFTFSSYP | 739 | ISYEGTNK | 918 | AKHMSMQEGAVTGEGQAAKDFIAWLVKGRVRADLVGDAFDV |

TABLE 12-continued

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-089 | 561 | GFSFSNYA | 740 | ISYDESNE | 919 | AKHMSMQEGAVTGEGQAAKEFIAWLVKGDVRADLVGDAFDV |
| GLP1R-222-083 | 562 | GFSFSSYG | 741 | ISYGGSNK | 920 | AKHMSMQEGAVTGEWQAAKEFIAWLVKGRVRADLVGDAFDV |
| GLP1R-222-001 | 563 | GFSFSNYA | 742 | TSYDESNK | 921 | AKHMSMQEGAVTGEGQAAKEFIAWLLKGRVRADLVGDAFDV |
| GLP1R-222-075 | 564 | GFTFSDYG | 743 | ISYDESNK | 922 | AKHMSMQEGAVTGEGWAAKEFIAWLVKGRVRADLVGDAFDV |
| GLP1R-222-071 | 565 | GFTFSDFA | 744 | ISYEGSNK | 923 | AKHMSMQEGAVQGEGQAAKEFIAWLVKGRVRADLVGDAFDV |
| GLP1R-222-069 | 566 | GFTFSDYP | 745 | ISDEGSNK | 924 | AKHMSMQEGAVTGEIQAAKEFIAWLVKGRVRADLVGDAFDV |
| GLP1R-222-002 | 567 | GFTFRDYA | 746 | ISYDATNK | 925 | AKHMSMQEGAVTGMGQAAKEFIAWLVKGRVRADLVGDAFDV |
| GLP1R-222-006 | 568 | GFTFNRYG | 747 | ISYDASNK | 926 | AKHMSMQEGAVTGEGQAAWEFIAWLVKGRVRADLVGDAFDV |
| GLP1R-222-055 | 569 | GFPFSSYG | 748 | ISYDATNK | 927 | AKHMSMQEGAVTGEGQAAKSFIAWLVKGRVRADLVGDAFDV |
| GLP1R-222-027 | 570 | GFSFGSYA | 749 | ISYDASNK | 928 | AKHMSMQEGAVTGMGQAAKEFIAWLVKGRVRADLVGDAFDV |
| GLP1R-222-066 | 571 | GFTFSNYD | 750 | ISYAGSNK | 929 | AKHMSMQEGAVTGTGQAAKEFIAWLVKGRVRADLVGDAFDV |
| GLP1R-222-015 | 572 | GFSFRTYG | 751 | ISDEGSNK | 930 | AKHMSMQEGAVTGEGYAAKEFIAWLVKGRVRADLVGDAFDV |
| GLP1R-222-076 | 573 | GFTFSTYG | 752 | ISYDANNK | 931 | AKHMSMQEGAVTGEGQAAVEFIAWLVKGRVRADLVGDAFDV |
| GLP1R-222-011 | 574 | GFSFSDYA | 753 | ISSDASNK | 932 | AKHMSMQEGAVTGYGQAAKEFIAWLVKGRVRADLVGDAFDV |
| GLP1R-222-065 | 575 | GFTFSNYA | 754 | ISYDATNK | 933 | AKHMSMQEGAVTGEAQAAKEFIAWLVKGRVRADLVGDAFDV |
| GLP1R-222-041 | 576 | GFTFSNYD | 755 | TSYDESKK | 934 | AKHMSMQEGAVTGKGQAAKEFIAWLVKGRVRADLVGDAFDV |
| GLP1R-222-028 | 577 | GFSFSNYA | 756 | TSYDESNK | 935 | AKHMSMQEGAVTGEGQAAYEFIAWLVKGRVRADLVGDAFDV |
| GLP1R-222-086 | 578 | GFTFSDYP | 757 | ISYAGSNE | 936 | AKHMSMQEGAVTGYGQAAKEFIAWLVKGRVRADLVGDAFDV |
| GLP1R-222-033 | 579 | GFPFSSYA | 758 | ISYDANNK | 937 | AKHMSMQEGAVTGYGQAAKEFIAWLVKGRVRADLVGDAFDV |

TABLE 12-continued

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-035 | 580 | GFAFSSYA | 759 | ISYDESNK | 938 | AKHMSMQEGAVTGEGWAAKEFIFWLVKGRVRADLVGDAFDV |
| GLP1R-222-045 | 581 | GFSFSNYA | 760 | ISFDESNK | 939 | AKHMSMQEGAVTGYGQAAKEFIAWLVKGRVRADLVGDAFDV |
| GLP1R-222-085 | 582 | GFTFSDYP | 761 | ISYDRSNE | 940 | AKHMSMQEGAVTGTGQAAKEFIAWLVKGRVRADLVGDAFDV |
| GLP1R-222-049 | 583 | GFSFSNYG | 762 | ISSDASNK | 941 | AKHMSMQEGAVTGEWQAAKEFIAWLVKGRVRADLVGDAFDV |
| GLP1R-222-078 | 584 | GFSFRNYG | 763 | ISYDESNK | 942 | AKHMSMQEGAVTGEGQAAKEFIAWLVKGRVRPDLVGDAFDV |
| GLP1R-222-021 | 585 | GFTFNDYG | 764 | ISSDASNK | 943 | AKHMSMQEGAVTGTGQAAKEFIAWLVKGRVRADLVGDAFDV |
| GLP1R-222-009 | 586 | GFTFGNYA | 765 | ISSDASNK | 944 | AKHMSMQEGAVTGEFQAAKEFIAWLVKGRVRADLVGDAFDV |
| GLP1R-222-036 | 587 | GFTFTNYG | 766 | ISSDASDK | 945 | AKHMSMQEGAVTGMGQAAKEFIAWLVKGRVRADLVGDAFDV |
| GLP1R-222-084 | 588 | GFSFSNYG | 767 | ISYGGSNK | 946 | AKHMSMQEGAVTGEGFAAKEFIAWLVKGRVRADLVGDAFDV |
| GLP1R-222-010 | 589 | GFTFSDYP | 768 | ISSDASDK | 947 | AKHMSMQEGAVTGEGQAAKEFIAWLVKGWVRADLVGDAFDV |
| GLP1R-222-088 | 590 | GFSFSNYA | 769 | ISYDASNK | 948 | AKHMSMQEGAVTGGGQAAKEFIAWLVKGRVRADLVGDAFDV |
| GLP1R-222-079 | 591 | GFPFSNYA | 770 | ISSDASNK | 949 | AKHMSMQEGAVTGEWQAAKEFIAWLVKGRVRADLVGDAFDV |
| GLP1R-222-040 | 592 | GFSFSDYG | 771 | ISYDANNK | 950 | AKHMSMQEGAVTGLGQAAKEFIAWLVKGRVRADLVGDAFDV |
| GLP1R-222-070 | 593 | GFTFGSYG | 772 | ISDEGSNK | 951 | AKHMSMQEGAVTNEGQAAKEFIAWLVKGRVRADLVGDAFDV |
| GLP1R-222-032 | 594 | GFTFNDYG | 773 | ISSDENNK | 952 | AKHMSMQEGAVTGEGQWAKEFIAWLVKGRVRADLVGDAFDV |
| GLP1R-222-030 | 595 | GFTFRDYG | 774 | ISSDENNK | 953 | AKHMSMQEGAVTGWGQAAKEFIAWLVKGRVRADLVGDAFDV |
| GLP1R-222-038 | 596 | GFTFGNYG | 775 | ISSDASHK | 954 | AKHMSMQEGAVTWEGQAAKEFIAWLVKGRVRADLVGDAFDV |
| GLP1R-222-031 | 597 | GFTFSGYA | 776 | ISSDENNK | 955 | AKHMSMQEGAVTGWGQAAKEFIAWLVKGRVRADLVGDAFDV |
| GLP1R-222-026 | 598 | GFTFSNYA | 777 | ISDEGSNK | 956 | AKHMSMQEGAVTGAGQAAKEFIAWLVKGRVRADLVGDAFDV |

TABLE 12-continued

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-054 | 599 | GFNFNNYG | 778 | ISYDESNK | 957 | AKHMSMQEGAVTGEWQAAKEFIAWLVKGRVRADLVGDAFDV |
| GLP1R-222-093 | 600 | GFTFSDYP | 779 | ISSDASDK | 958 | AKHMSMQEGAVTGHGQAAKEFIAWLVKGRVRADLVGDAFDV |
| GLP1R-222-051 | 601 | GFTFNNYP | 780 | ISYGGSDK | 959 | AKHMSMQEGAVTGEGWAAKEFIAWLVKGRVRADLVGDAFDV |
| GLP1R-222-067 | 602 | GFTFSDYA | 781 | IPYDESNK | 960 | AKHMSMQEGAVTGEGQAAKNFIAWLVKGRVRADLVGDAFDV |
| GLP1R-222-059 | 603 | GFAFSNYG | 782 | ISDEGSNK | 961 | AKHMSMQEGAVTGHGQAAKEFIAWLVKGRVRADLVGDAFDV |
| GLP1R-222-025 | 604 | GFTFNRYG | 783 | ISDEGSNK | 962 | AKHMSMQEGAVTGVGQAAKEFIAWLVKGRVRADLVGDAFDV |
| GLP1R-222-068 | 605 | GFIFSNYA | 784 | ISYDASNK | 963 | AKHMSMQEGAVTGEYQAAKEFIAWLVKGRVRADLVGDAFDV |
| GLP1R-222-053 | 606 | GFNFNNYG | 785 | ISSDASNK | 964 | AKHMSMQEGAVTGEGQAVKEFIAWLVKGRVRADLVGDAFDV |
| GLP1R-222-018 | 607 | GFTFGSYG | 786 | ISSDENNK | 965 | AKHMSMQEGAVTGEGFAAKEFIAWLVKGRVRADLVGDAFDV |
| GLP1R-222-047 | 608 | GFTFGSYA | 787 | TSYDESNK | 966 | AKHMSMQEGAVTGYGQAAKEFIAWLVKGRVRADLVGDAFDV |
| GLP1R-222-060 | 609 | GFTFSNYD | 788 | ISDEGSNK | 967 | AKHMSMQEGAVTGEGWAAKEFIAWLVKGRVRADLVGDAFDV |
| GLP1R-222-020 | 610 | GFTFKNYG | 789 | ISYGGSNK | 968 | AKHMSMQEGAVTGEGPAAKEFIAWLVKGRVRADLVGDAFDV |
| GLP1R-222-044 | 611 | GFSFSDYA | 790 | ISDDGSNK | 969 | AKHMSMQEGAVTGEGQAAKEFIAWLVKGFVRADLVGDAFDV |
| GLP1R-222-080 | 612 | GFSFSDYG | 791 | ISSDASDK | 970 | AKHMSMQEGAVTGEGQALKEFIAWLVKGRVRADLVGDAFDV |
| GLP1R-222-057 | 613 | GFTFGSYG | 792 | ISSDENNK | 971 | AKHMSMQEGAVTGMGQAAKEFIAWLVKGRVRADLVGDAFDV |
| GLP1R-222-043 | 614 | GFTLSNYA | 793 | IPYDESNK | 972 | AKHMSMQEGAVTGVGQAAKEFIAWLVKGRVRADLVGDAFDV |
| GLP1R-222-003 | 615 | GFTFSNFA | 794 | ISSDASNK | 973 | AKHMSMQEGAVTGEGQSAKEFIAWLVKGRVRADLVGDAFDV |
| GLP1R-222-037 | 616 | GFTFRNFG | 795 | ISSDASNK | 974 | AKHMSMQEGAVTGIGQAAKEFIAWLVKGRVRADLVGDAFDV |

TABLE 12-continued

| Variable Heavy Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-091 | 617 | GFTFGSHG | 796 | ISSDENNK | 975 | AKHMSMQEGAVTGEGQAIKEFIAWLVKGRVRADLVGDAFDV |
| GLP1R-222-019 | 618 | GFNFNNYG | 797 | ISDEGSNK | 976 | AKHMSMQEGAVTGEGQAAKEFIAWLVKGRVRPDLVGDAFDV |
| GLP1R-222-094 | 619 | GFTFGSYG | 798 | ISYDASNK | 977 | AKHMSMQEGAVTGWGQAAKEFIAWLVKGRVRADLVGDAFDV |

TABLE 13

| Variable Light Chain CDRs | | | | | | |
|---|---|---|---|---|---|---|
| Variant | SEQ ID NO | CDR1 | SEQ ID NO | CDR2 | SEQ ID NO | CDR3 |
| GLP1R-3 | 978 | SSNIADNY | 1157 | DNN | 1336 | GTWDNYLGAGV |
| GLP1R221-065 | 979 | TSNIANNF | 1158 | DHN | 1337 | GTWDTSLSAGA |
| GLP1R221-075 | 980 | GSNIGNND | 1159 | DND | 1338 | GTWDTSLSNYV |
| GLP1R221-017 | 981 | SSNIGNTY | 1160 | DDY | 1339 | ATWDATLNTGV |
| GLP1R221-033 | 982 | SSNIGNEY | 1161 | DNN | 1340 | ATWDTSLNVGV |
| GLP1R221-076 | 983 | SSNIGNND | 1162 | ENN | 1341 | LTWDHSLTAYV |
| GLP1R221-092 | 984 | TSNIANNF | 1163 | DNN | 1342 | GTWDTSLSVGM |
| GLP1R221-034 | 985 | SSNIGNNP | 1164 | END | 1343 | ATWDRGLSTGV |
| GLP1R221-066 | 986 | SSNIGNNY | 1165 | ENN | 1344 | GIWDRSLSAWV |
| GLP1R221-084 | 987 | SSNIADNY | 1166 | ENN | 1345 | GTWDVSLSVGM |
| GLP1R221-009 | 988 | SSNIGNQY | 1167 | DDH | 1346 | GTWDTSLSVGE |
| GLP1R221-072 | 989 | SSNIGRNF | 1168 | DHN | 1347 | GTWDVTLHTGV |
| GLP1R221-044 | 990 | SSNIGNND | 1169 | DNN | 1515 | GTWDTSLSGGV |
| GLP1R221-012 | 991 | SSTIGNNY | 1170 | EDD | 1516 | ATWDRGLSTGV |
| GLP1R221-042 | 992 | SSNIGNKY | 1171 | DDD | 1517 | GTWDTSLSVGM |
| GLP1R221-051 | 993 | SSNIGNDY | 1172 | DNN | 1518 | GTWDRGPNTGV |
| GLP1R221-083 | 994 | SSNIGSKD | 1173 | DDD | 1519 | GTWDRSLGGWV |
| GLP1R221-040 | 995 | SSNIGDND | 1174 | DNN | 1353 | GTWDRSLNVGV |
| GLP1R221-052 | 996 | SSNIGSKY | 1175 | DNN | 1354 | GTWDRGPNTGV |
| GLP1R221-003 | 997 | SSNIGNNP | 1176 | DND | 1355 | ATWDHSLRVGV |
| GLP1R221-094 | 998 | SSNIGNKY | 1177 | DNN | 1356 | GTWDTALTAGV |
| GLP1R221-001 | 999 | SSNIGSHY | 1178 | DTN | 1357 | ATWDRGLSTGV |
| GLP1R221-014 | 1000 | SSTIGNNY | 1179 | DND | 1358 | ATWDTSLNVGV |
| GLP1R221-085 | 1001 | TSNIGNNH | 1180 | DNN | 1359 | GTWDRSLSSAV |
| GLP1R221-022 | 1002 | SSNIGSNY | 1181 | DNN | 1360 | GTWDTSVSAGV |
| GLP1R221-056 | 1003 | GSNIGNND | 1182 | DTN | 1361 | ATWDRTLSIGV |
| GLP1R221-088 | 1004 | SSNIGSKY | 1183 | DNN | 1362 | GTWDTTLNIGV |

TABLE 13-continued

Variable Light Chain CDRs

| Variant | SEQ ID NO | CDR1 | SEQ ID NO | CDR2 | SEQ ID NO | CDR3 |
|---|---|---|---|---|---|---|
| GLP1R221-077 | 1005 | SSNIGNND | 1184 | GDD | 1363 | ATWDRSLRAGV |
| GLP1R221-027 | 1006 | SSNIGNDF | 1185 | DNN | 1364 | GTWDTSLSTGV |
| GLP1R221-019 | 1007 | SSNIGNNF | 1186 | DNN | 1365 | GTWETSLSAGV |
| GLP1R221-029 | 1008 | SSNIGNND | 1187 | EDN | 1366 | GTWVTSLSAGV |
| GLP1R221-043 | 1009 | SSNIGNHD | 1188 | DNN | 1367 | GTWDRSLSGEV |
| GLP1R221-082 | 1010 | SSNIGSNF | 1189 | DDK | 1368 | ATWDRGLSTGV |
| GLP1R221-079 | 1011 | SSNIGDND | 1190 | DND | 1369 | ATWDRSLSAVV |
| GLP1R221-080 | 1012 | SSNIGNND | 1191 | DDD | 1370 | GTWDKSLSAVV |
| GLP1R221-059 | 1013 | SSNIGDND | 1192 | ENN | 1371 | GTWDTSLSGGV |
| GLP1R221-069 | 1014 | SSNIGKNF | 1193 | DNN | 1372 | GTWDVTLHTGV |
| GLP1R221-036 | 1015 | SSNIGNEY | 1194 | ENK | 1373 | GTWDASLSAGL |
| GLP1R221-057 | 1016 | SSNIGSKY | 1195 | DNN | 1374 | GTWESSLSAGV |
| GLP1R221-035 | 1017 | SSDIGNKY | 1196 | ENN | 1375 | ATWDASLSGGV |
| GLP1R221-063 | 1018 | SSNIGNNF | 1197 | ENN | 1376 | ATWDATLNTGV |
| GLP1R221-090 | 1019 | SSNIGSNY | 1198 | DTD | 1377 | GTWDVSLNTQV |
| GLP1R221-002 | 1020 | SSNIGNKY | 1199 | DTN | 1378 | ATWDATLNTGV |
| GLP1R221-087 | 1021 | SSNIGKDY | 1200 | ENV | 1379 | GTWDASLSGVV |
| GLP1R221-038 | 1022 | TSNIGNND | 1201 | DNN | 1380 | GTWDVTLHTGV |
| GLP1R221-060 | 1023 | GSNIGNND | 1202 | ETN | 1381 | GTWDTGLSAGV |
| GLP1R221-015 | 1024 | TSNIGNNY | 1203 | DTN | 1382 | ATWDATLNTGV |
| GLP1R221-020 | 1025 | SSNIGRNF | 1204 | DNN | 1383 | GTWDTSLSRYV |
| GLP1R221-011 | 1026 | SSNIGKDY | 1205 | DNY | 1384 | GTWDTSLSVGV |
| GLP1R221-091 | 1027 | SSNIGSND | 1206 | VND | 1385 | GAWDRSLSAYV |
| GLP1R221-086 | 1028 | SSNIGKHY | 1207 | DVD | 1386 | ATWDRGLSTGV |
| GLP1R221-074 | 1029 | SSNIGSNY | 1208 | DNN | 1387 | GTWDTRLSVGV |
| GLP1R221-032 | 1030 | SSNIGNNY | 1209 | DNN | 1388 | ATWDRSLRAGV |
| GLP1R221-013 | 1031 | SSNIGNKY | 1210 | DDD | 1389 | ATWDTSLNVGV |
| GLP1R221-058 | 1032 | SSNIGKYY | 1211 | DNN | 1390 | GTWDTSLATGL |
| GLP1R221-031 | 1033 | SSNIGSNL | 1212 | DNN | 1391 | GTWDTSLSAGA |
| GLP1R221-054 | 1034 | RSNIGNYY | 1213 | DHN | 1392 | ATWDRTLSIGV |
| GLP1R221-021 | 1035 | SSNIGNNF | 1214 | DNN | 1393 | GAWDRSLSAGV |
| GLP1R221-016 | 1036 | SSNIGNKY | 1215 | DND | 1394 | ATWDATLNTGV |
| GLP1R221-030 | 1037 | SSNIENND | 1216 | ENN | 1395 | GTWDRSLSAAL |
| GLP1R221-018 | 1038 | SSNIGSNH | 1217 | ENT | 1396 | ATWDATLNTGV |
| GLP1R221-028 | 1039 | SSTIGNNY | 1218 | DND | 1397 | GTWDKSLSAGV |
| GLP1R221-023 | 1040 | SSNIGSKD | 1219 | DTN | 1398 | ATWDRGLSTGV |
| GLP1R221-089 | 1041 | SSNIGKDF | 1220 | DND | 1399 | ATWDTSLSAEV |

TABLE 13-continued

Variable Light Chain CDRs

| Variant | SEQ ID NO | CDR1 | SEQ ID NO | CDR2 | SEQ ID NO | CDR3 |
|---|---|---|---|---|---|---|
| GLP1R221-053 | 1042 | SSNIGKDY | 1221 | EDN | 1400 | ATWDRTLSIGV |
| GLP1R221-071 | 1043 | SSNIGSNY | 1222 | DDN | 1401 | GTWGSSLSAGL |
| GLP1R221-055 | 1044 | SSNIGSND | 1223 | DKN | 1402 | GAWDRSLSAGV |
| GLP1R221-046 | 1045 | SSNIGNND | 1224 | DDD | 1403 | AAWDDYLSAVV |
| GLP1R221-039 | 1046 | SSNIGNHF | 1225 | DNN | 1404 | GTWDRSLNVGV |
| GLP1R221-078 | 1047 | SSNIGNNP | 1226 | ENI | 1405 | ATWDRSLRAGV |
| GLP1R221-010 | 1048 | SSTIGNNY | 1227 | DNN | 1406 | GTWDASLSVWV |
| GLP1R221-005 | 1049 | SSTIGNNY | 1228 | ENR | 1407 | GTWDNYLGAGV |
| GLP1R221-073 | 1050 | SSNIGSNH | 1229 | END | 1408 | GTWDTSLSAYI |
| GLP1R221-041 | 1051 | SSNIGSKY | 1230 | NDN | 1409 | GTWDTSLSVGM |
| GLP1R221-025 | 1052 | SSNIGKYY | 1231 | DNY | 1410 | ATWDRGLSTGV |
| GLP1R221-007 | 1053 | SSNIGNND | 1232 | ENT | 1411 | GTWDANLRAGV |
| GLP1R221-093 | 1054 | SSNIENNH | 1233 | END | 1412 | ATWDTSLSEGV |
| GLP1R221-024 | 1055 | SSNIGKYY | 1234 | DTN | 1413 | ATWDRGLSTGV |
| GLP1R221-008 | 1056 | SSSIGNNY | 1235 | ANN | 1414 | GTWDISLSAAV |
| GLP1R221-050 | 1057 | SSNIGNNF | 1236 | DKN | 1415 | ATWDTRLSAVV |
| GLP1R221-062 | 1058 | SSNIGNNY | 1237 | ENN | 1416 | GTWDASLGAWV |
| GLP1R221-068 | 1059 | SSNIGSND | 1238 | NNN | 1417 | GTWDARLGGAV |
| GLP1R221-067 | 1060 | SSNIGNNY | 1239 | ANN | 1418 | GTWDARLGGAV |
| GLP1R221-061 | 1061 | SSNIGTNF | 1240 | DNN | 1419 | GTWDNRLSGWV |
| GLP1R221-064 | 1062 | SSNIGKDY | 1241 | ENT | 1420 | ATWDATLNTGV |
| GLP1R221-070 | 1063 | SSNIENNH | 1242 | QNN | 1421 | GTWDVSLNTQV |
| GLP1R221-006 | 1064 | SSNIGNNH | 1243 | GSN | 1422 | GTWDTSLNIGV |
| GLP1R221-045 | 1065 | SSNIGNND | 1244 | GNN | 1423 | GTWDTSLSGGI |
| GLP1R221-004 | 1066 | SSTIGNNY | 1245 | DND | 1424 | GTWESSLSAGV |
| GLP1R221-047 | 1067 | SSNIGNEY | 1246 | GDD | 1425 | GTWDTSLSVGM |
| GLP1R221-048 | 1068 | SSNIGNHD | 1247 | AND | 1426 | GTWDTSLSVGE |
| GLP1R-222-052 | 1069 | SSNIGKRS | 1248 | DNN | 1427 | VTWDRSLSAGV |
| GLP1R-222-016 | 1070 | SSNIENND | 1249 | DFN | 1428 | GTWDTSLSVGM |
| GLP1R-222-023 | 1071 | SSNIGNND | 1250 | ENT | 1429 | GTWDAGLSTGV |
| GLP1R-222-014 | 1072 | SSNIGNHD | 1251 | DNN | 1430 | GTWDTSLSAGV |
| GLP1R-222-090 | 1073 | SSNIADNY | 1252 | DNN | 1431 | ATWDNRLSAGV |
| GLP1R-222-073 | 1074 | GSNIGNND | 1253 | DNN | 1432 | GTWDRGPNTGV |
| GLP1R-222-012 | 1075 | SSNIGNND | 1254 | DDD | 1433 | GTWDTSLSVGE |
| GLP1R-222-082 | 1076 | SSNIGSKY | 1255 | DNN | 1434 | GTWDISPSAWV |
| GLP1R-222-081 | 1077 | SSNIGSDY | 1256 | DNN | 1435 | GTWDESLRSWV |
| GLP1R-222-056 | 1078 | SSNIGSNY | 1257 | DND | 1436 | GTWDTSLSVGE |
| GLP1R-222-058 | 1079 | SSNIGNNP | 1258 | DNN | 1437 | ATWDNKLTSGV |

TABLE 13-continued

| Variable Light Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-063 | 1080 | SSNIGNYY | 1259 | DNN | 1438 | ATWDTSLNVGV |
| GLP1R-222-042 | 1081 | SSNIGNND | 1260 | DDN | 1439 | GTWDTSLSAYI |
| GLP1R-222-092 | 1082 | SSNIGSDY | 1261 | ENN | 1440 | GTWDRGPNTGV |
| GLP1R-222-007 | 1083 | SSDIGNKY | 1262 | ENN | 1441 | GTWDTSLSAGA |
| GLP1R-222-008 | 1084 | SSNIGSNH | 1263 | DNN | 1442 | GTWDTSLSVGE |
| GLP1R-222-024 | 1085 | TSNIGSNF | 1264 | DEN | 1443 | ATWDATLNTGV |
| GLP1R-222-062 | 1086 | SSNIENND | 1265 | DNN | 1444 | GTWDRSLNVGV |
| GLP1R-222-077 | 1087 | SSSIGNNY | 1266 | ENN | 1445 | GTWDNNLGAGV |
| GLP1R-222-064 | 1088 | SSNIGSKY | 1267 | DDN | 1446 | GTWDTSLSTGV |
| GLP1R-222-074 | 1089 | SSNIGNND | 1268 | DNN | 1447 | GTWDRGPNTGV |
| GLP1R-222-029 | 1090 | SSNIGNNY | 1269 | END | 1448 | GTWDTSLATGL |
| GLP1R-222-046 | 1091 | TSNIGNNY | 1270 | ENT | 1449 | GTWDTTLSAGV |
| GLP1R-222-005 | 1092 | SSNIGNDY | 1271 | DNN | 1450 | GTWDASLSAGL |
| GLP1R-222-004 | 1093 | SSNIGNDY | 1272 | ENN | 1451 | GTWDASLSAGL |
| GLP1R-222-022 | 1094 | SSNIGNND | 1273 | DND | 1452 | GTWDRTLSIGV |
| GLP1R-222-087 | 1095 | SSNIENND | 1274 | DNN | 1453 | GTWDRRLSDVV |
| GLP1R-222-048 | 1096 | RSNIGNNF | 1275 | DNN | 1454 | GTWDRSLSSAV |
| GLP1R-222-072 | 1097 | SSSIGNNY | 1276 | DTN | 1455 | GTWDRSLNVGV |
| GLP1R-222-089 | 1098 | SSNIGNND | 1277 | DTN | 1456 | GTWDISLSARV |
| GLP1R-222-083 | 1099 | SSNIGSKY | 1278 | DND | 1457 | ATWDTSLSAGV |
| GLP1R-222-001 | 1100 | SSNIGSKY | 1279 | DNN | 1458 | GTWDTSLATGL |
| GLP1R-222-075 | 1101 | SSNIGSKD | 1280 | DTY | 1459 | GTWDTSVSAGV |
| GLP1R-222-071 | 1102 | TSNIGNNY | 1281 | DDN | 1460 | GTWDRSLNVGV |
| GLP1R-222-069 | 1103 | SSNIGSHY | 1282 | DNN | 1461 | GTWHSSLSAGV |
| GLP1R-222-002 | 1104 | SSDIGNKY | 1283 | DND | 1462 | GTWDTTLSAGV |
| GLP1R-222-006 | 1105 | SSNIGNND | 1284 | DNN | 1463 | GAWDTSLSAVV |
| GLP1R-222-055 | 1106 | TSNIGNNY | 1285 | DNN | 1464 | GTWDTSLSVGE |
| GLP1R-222-027 | 1107 | TSNIGNNH | 1286 | EDN | 1465 | GTWDTSLATGL |
| GLP1R-222-066 | 1108 | SSTIGNNY | 1287 | DNN | 1466 | ATWDRGLSTGV |
| GLP1R-222-015 | 1109 | RSNIGNYY | 1288 | DND | 1467 | GTWDRSLSVGL |
| GLP1R-222-076 | 1110 | SSNIGSKY | 1289 | DTY | 1468 | GTWDAGLSTGV |
| GLP1R-222-011 | 1111 | SSNIGSNY | 1290 | ENN | 1469 | GTWDTSLSVGE |
| GLP1R-222-065 | 1112 | SSTIGNNY | 1291 | DNN | 1470 | ATWDRTLSIGV |
| GLP1R-222-041 | 1113 | SSNIGSKD | 1292 | DDN | 1471 | GIWDRSLSAWV |
| GLP1R-222-028 | 1114 | TSNIGNNH | 1293 | DNN | 1472 | GTWDTSLATGL |
| GLP1R-222-086 | 1115 | SSNIGNHF | 1294 | DTN | 1473 | GTWDRGPNTGV |
| GLP1R-222-033 | 1116 | SSNIGKYY | 1295 | DNN | 1474 | GTWDVSLSVGM |

TABLE 13-continued

| Variable Light Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-035 | 1117 | SSNIGNND | 1296 | ENN | 1475 | GTWDVSLSVGM |
| GLP1R-222-045 | 1118 | SSNIGNTY | 1297 | ENR | 1476 | ATWDTSLSEGV |
| GLP1R-222-085 | 1119 | SSNIGSDY | 1298 | ANN | 1477 | GTWDVTLHAGV |
| GLP1R-222-049 | 1120 | TSNIGKNF | 1299 | ENK | 1478 | ATWDRSLSAGV |
| GLP1R-222-078 | 1121 | SSNIGKYY | 1300 | DTN | 1479 | GTWDNNLGAGV |
| GLP1R-222-021 | 1122 | SSNIGDND | 1301 | ENR | 1480 | GTWDASLSAGL |
| GLP1R-222-009 | 1123 | SSNIGKNF | 1302 | DTN | 1481 | GTWDTSLSVGE |
| GLP1R-222-036 | 1124 | SSNIGSKY | 1303 | DNN | 1482 | ATWDDTLTAGV |
| GLP1R-222-084 | 1125 | SSNIGSKD | 1304 | DNN | 1483 | GIWDTSLSAWV |
| GLP1R-222-010 | 1126 | SSNIGNKY | 1305 | DNN | 1484 | GTWDNRLSAGV |
| GLP1R-222-088 | 1127 | SSNIGNNF | 1306 | DND | 1485 | GTWDTSLRVVV |
| GLP1R-222-079 | 1128 | SSNIGSND | 1307 | NNN | 1486 | GTWESGLSAGV |
| GLP1R-222-040 | 1129 | SSNIGNQY | 1308 | DTY | 1487 | ATWDHSLRVGV |
| GLP1R-222-070 | 1130 | SSNIGNND | 1309 | ANN | 1488 | GTWHSSLSAGV |
| GLP1R-222-032 | 1131 | SSNIGNNP | 1310 | END | 1489 | GTWDTRLSVGV |
| GLP1R-222-030 | 1132 | SSNIGNNL | 1311 | DND | 1490 | GTWDTSLTAGV |
| GLP1R-222-038 | 1133 | SSNIGNKY | 1312 | DTN | 1491 | ATWDATLNTGV |
| GLP1R-222-031 | 1134 | SSNIGNNY | 1313 | DDN | 1492 | GTWDTSLSVGM |
| GLP1R-222-026 | 1135 | SSNIGSKY | 1314 | DNN | 1493 | GTWDRGPNTGV |
| GLP1R-222-054 | 1136 | SSNIGSKY | 1315 | DDY | 1494 | GTWDNRLSGWV |
| GLP1R-222-093 | 1137 | RSNIGNNF | 1316 | DNY | 1495 | ATWDRGLSTGV |
| GLP1R-222-051 | 1138 | RSNIGNNF | 1317 | DNN | 1496 | ATWDRSLSAGV |
| GLP1R-222-067 | 1139 | RSNIGNNF | 1318 | DNN | 1497 | GTWDRRLSAVV |
| GLP1R-222-059 | 1140 | SSNIGNEY | 1319 | ENN | 1498 | GTWDNYLGAVV |
| GLP1R-222-025 | 1141 | SSNIGNEY | 1320 | DND | 1499 | ATWDATLNTGV |
| GLP1R-222-068 | 1142 | RSNIGNNF | 1321 | ENN | 1500 | GSWDRSLSAVV |
| GLP1R-222-053 | 1143 | SSNIGNND | 1322 | ASN | 1501 | ATWDNILSAWV |
| GLP1R-222-018 | 1144 | SSNIGKNF | 1323 | ETN | 1502 | ATWDRGLSTGV |
| GLP1R-222-047 | 1145 | SSNIGTNF | 1324 | ADN | 1503 | GTWDRTLSIGV |
| GLP1R-222-060 | 1146 | SSNIGNNP | 1325 | GNN | 1504 | GTWDASLGAVV |
| GLP1R-222-020 | 1147 | SSNIGNND | 1326 | DND | 1505 | GTWDAGLSTGV |
| GLP1R-222-044 | 1148 | SSNIGNNH | 1327 | DFN | 1506 | ATWDRSLRAGV |
| GLP1R-222-080 | 1149 | SSNIGNHD | 1328 | ENK | 1507 | GTWESGLSAGV |
| GLP1R-222-057 | 1150 | SSNIGDHY | 1329 | ENN | 1508 | ATWDNKLTSGV |
| GLP1R-222-043 | 1151 | SSNIGNNY | 1330 | DNN | 1509 | ATWDRSLRAGV |
| GLP1R-222-003 | 1152 | SSNIGNHD | 1331 | ENN | 1510 | GTWDTSLSAGV |
| GLP1R-222-037 | 1153 | SSNIGNNP | 1332 | NNN | 1511 | ATWDTTLNTGV |
| GLP1R-222-091 | 1154 | SSNIGSNY | 1333 | GND | 1512 | ASWDNRLTAVV |

TABLE 13-continued

| Variable Light Chain CDRs | | | | | | |
|---|---|---|---|---|---|---|
| Variant | SEQ ID NO | CDR1 | SEQ ID NO | CDR2 | SEQ ID NO | CDR3 |
| GLP1R-222-019 | 1155 | SSNIGNNY | 1334 | DNN | 1513 | ATWDRGLSTGV |
| GLP1R-222-094 | 1156 | SSNIGNTY | 1335 | ENK | 1514 | ATWDTSLSEGV |

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (1530 sequences)

SEQ ID NO: 1 - protein, 43 aa, Artificial Sequence
  Description of Artificial Sequence: Synthetic polypeptide
CAKHMSMQEGAVTGEGQAAKEFIAWLVKGRVRADLVGDAFDVW

SEQ ID NO: 2 - protein, 52 aa, Artificial Sequence
  Description of Artificial Sequence: Synthetic polypeptide
CARDGRGSLPRPKGGPQTVGEGQAAKEFIAWLVKGGLTYDSSEDSGGAFDIW

SEQ ID NO: 3 - protein, 44 aa, Artificial Sequence
  Description of Artificial Sequence: Synthetic polypeptide
CAKHMSMQDYLVIGEGQAAKEFIAWLVKGGPARADLVGDAFDVW

SEQ ID NO: 4 - protein, 43 aa, Artificial Sequence
  Description of Artificial Sequence: Synthetic polypeptide
CAKHMSMQEGAVTGEGQDAKEFIAWLVKGRVRADLVGDAFDVW

SEQ ID NO: 5 - protein, 43 aa, Artificial Sequence
  Description of Artificial Sequence: Synthetic polypeptide
WAKHMSMQEGAVTGEGQAAKEFIAWLVKGRVRADLVGDAFDVW

SEQ ID NO: 6 - protein, 49 aa, Artificial Sequence
  Description of Artificial Sequence: Synthetic polypeptide
CARDGRGSLPRPKGGPQTVGEGQAAKEFIAWLVKGRVRADLVGDAFDVW

SEQ ID NO: 7 - protein, 51 aa, Artificial Sequence
  Description of Artificial Sequence: Synthetic polypeptide
CARANQHFYEQEGTFTSDVSSYLEGQAAKEFIAWLVKGGIRGYHYYGMDVW

SEQ ID NO: 8 - protein, 44 aa, Artificial Sequence
  Description of Artificial Sequence: Synthetic polypeptide
CARANQHFTELHGEGQAAKEFIAWLVKGRGQIDIGYHYYGMDVW

SEQ ID NO: 9 - protein, 45 aa, Artificial Sequence
  Description of Artificial Sequence: Synthetic polypeptide
CARANQHFLGAGVSSYLEGQAAKEFIAWLVKGDTTGYHYYGMDVW

SEQ ID NO: 10 - protein, 50 aa, Artificial Sequence
  Description of Artificial Sequence: Synthetic polypeptide
CARANQHFLDKGTFTSDVSSYLEGQAAKEFIAWLVKGIYPGYHYYGMDVW

SEQ ID NO: 11 - protein, 46 aa, Artificial Sequence
  Description of Artificial Sequence: Synthetic polypeptide
CARANQHFGTLSAGEGQAAKEFIAWLVKGGSQYDSSEDSGGAFDIW

SEQ ID NO: 12 - protein, 43 aa, Artificial Sequence
  Description of Artificial Sequence: Synthetic polypeptide
CARANQHFGLHAQGEGQAAKEFIAWLVKGSGTYGYHYYGMDVW

SEQ ID NO: 13 - protein, 42 aa, Artificial Sequence
  Description of Artificial Sequence: Synthetic polypeptide
CARANQHFGGKGEGQAAKEFIAWLVKGGGSGAGYHYYGMDVW

SEQ ID NO: 14 - protein, 43 aa, Artificial Sequence
  Description of Artificial Sequence: Synthetic polypeptide
CAKQMSMQEGAVTGEGQAAKEFIAWLVKGRVRADLVGDAFDVW

SEQ ID NO: 15 - protein, 44 aa, Artificial Sequence
  Description of Artificial Sequence: Synthetic polypeptide
CAKHMSMQEGAVTGEGQAAKEFIAWLVKGGPARADLVGDAFDVW

SEQ ID NO: 16 - protein, 46 aa, Artificial Sequence
  Description of Artificial Sequence: Synthetic polypeptide
CAKHMSMQEGAVTGEGQAAKEFIAWLVKGGLTYDSSEDSGGAFDIW

SEQ ID NO: 17 - protein, 43 aa, Artificial Sequence
  Description of Artificial Sequence: Synthetic polypeptide
CAKHMSMQDYLVIGEGQAAKEFIAWLVKGRVRADLVGDAFDVW

SEQ ID NO: 18 - protein, 29 aa, Artificial Sequence
  Description of Artificial Sequence: Synthetic peptide
CARANQHFVDLYGWHGVPKGYHYYGMDVW

SEQ ID NO: 19 - protein, 40 aa, Artificial Sequence
  Description of Artificial Sequence: Synthetic polypeptide
CARDMYYDFETVVEGIQWYEALKAGKLGEVVPADDAFDIW

SEQ ID NO: 20 - protein, 43 aa, Artificial Sequence; identical to SEQ ID NO: 1
  Description of Artificial Sequence: Synthetic polypeptide

SEQ ID NO: 21 - protein, 52 aa, Artificial Sequence; identical to SEQ ID NO: 2
  Description of Artificial Sequence: Synthetic polypeptide

SEQ ID NO: 22 - protein, 42 aa, Artificial Sequence
  Description of Artificial Sequence: Synthetic polypeptide
CARANQHFFVPGSLKVWLKGVAPESSSEYDSSEDSGGAFDIW

SEQ ID NO: 23 - protein, 42 aa, Artificial Sequence
  Description of Artificial Sequence: Synthetic polypeptide
CARANQHFLSHAGAARDFINWLIQTKITGLGSGYHYYGMDVW

SEQ ID NO: 24 - protein, 41 aa, Artificial Sequence
  Description of Artificial Sequence: Synthetic polypeptide
CAKHMSMQEGVLQGQIPSTIDWEGLLHLIRADLVGDAFDVW

SEQ ID NO: 25 - protein, 48 aa, Artificial Sequence
  Description of Artificial Sequence: Synthetic polypeptide
CARDMYYDFLKIGDNLAARDFINWLIQTKITDGTDTEVVPADDAFDIW

SEQ ID NO: 26 - protein, 46 aa, Artificial Sequence
  Description of Artificial Sequence: Synthetic polypeptide
CARDGRGSLPRPKGGPKFVPGKHETYGHKTGYRLRPGYHYYGMDVW

SEQ ID NO: 27 - protein, 42 aa, Artificial Sequence
  Description of Artificial Sequence: Synthetic polypeptide
CARANQHFFSGAEGEGQAAKEFIAWLVKGIIPGYHYYGMDVW

SEQ ID NO: 28 - protein, 43 aa, Artificial Sequence; identical to SEQ ID NO: 12
  Description of Artificial Sequence: Synthetic polypeptide

SEQ ID NO: 29 - protein, 44 aa, Artificial Sequence; identical to SEQ ID NO: 3
  Description of Artificial Sequence: Synthetic polypeptide

SEQ ID NO: 30 - protein, 51 aa, Artificial Sequence
  Description of Artificial Sequence: Synthetic polypeptide
CARDGRGSLPRPKGGPPSSGRDFINWLIQTKITDGFRYDSSEDSGGAFDIW

SEQ ID NO: 31 - protein, 65 aa, Artificial Sequence
  Description of Artificial Sequence: Synthetic polypeptide
CARDLRELECEEWTRHGGKKHHGKRQSNRAHQGKHETYGHKTGSLVPSRGPCVDPRGVAGSFDVW

SEQ ID NO: 32 - protein, 54 aa, Artificial Sequence
  Description of Artificial Sequence: Synthetic polypeptide
CARDMYYDFHPEGTFTSDVSSYLEGQAAKEFIAWLVKGSLIYEVVPADDAFDIW

SEQ ID NO: 33 - protein, 62 aa, Artificial Sequence
  Description of Artificial Sequence: Synthetic polypeptide
CARANQHFGPVAGGATPSEEPGSQLTRAELGWDAPPGQESLADELLQLGTEHGYHYYGMDVW

SEQ ID NO: 34 - protein, 43 aa, Artificial Sequence; identical to SEQ ID NO: 1
  Description of Artificial Sequence: Synthetic polypeptide

SEQ ID NO: 35 - protein, 42 aa, Artificial Sequence; identical to SEQ ID NO: 23
  Description of Artificial Sequence: Synthetic polypeptide

SEQ ID NO: 36 - protein, 41 aa, Artificial Sequence
  Description of Artificial Sequence: Synthetic polypeptide
CARDGRGSLPRPKGGPHSGRLGSGYKSYDSSEDSGGAFDIW

SEQ ID NO: 37 - protein, 37 aa, Artificial Sequence
  Description of Artificial Sequence: Synthetic polypeptide
CARANQHFSQAGRAARVPGPSSSLGPRGYHYYGMDVW

SEQ ID NO: 38 - protein, 48 aa, Artificial Sequence
  Description of Artificial Sequence: Synthetic polypeptide
CAKHMSMQSQGLDNLAARDFINWLIQTKITDGFELSRADLVGDAFDVW

SEQ ID NO: 39 - protein, 53 aa, Artificial Sequence
  Description of Artificial Sequence: Synthetic polypeptide
CARDMYYDFFGLGTFTSDVSSYLEGQAAKEFIAWLVKGVSPEVVPADDAFDIW

SEQ ID NO: 40 - protein, 56 aa, Artificial Sequence
  Description of Artificial Sequence: Synthetic polypeptide
CAKHMSMQGSVAGGTFTSDVSSYLEGQAAKEFIAWLVKGGPSFIRADLVGDAFDVW

SEQ ID NO: 41 - protein, 53 aa, Artificial Sequence
  Description of Artificial Sequence: Synthetic polypeptide
CAKHMSMQADTGTFTSDVSSYLEGQAAKEFIAWLVKGEFSSRADLVGDAFDVW

SEQ ID NO: 42 - protein, 45 aa, Artificial Sequence
  Description of Artificial Sequence: Synthetic polypeptide
CARANQHFFGKGDNLAARDFINWLIQTKITDGSNPGYHYYGMDVW

SEQ ID NO: 43 - protein, 43 aa, Artificial Sequence
  Description of Artificial Sequence: Synthetic polypeptide
CARANQHFAATGAGEGQAAKEFIAWLVKGRVEIGYHYYGMDVW

SEQ ID NO: 44 - protein, 488 aa, Artificial Sequence
  Description of Artificial Sequence: Synthetic polypeptide
MEWSWVFLFFLSVTTGVHSQVQLVQSGAEVKKPGSSVKVSCKASGGSFSSHAISWVRQAPGQGLEWMGGIIPIFGAPNYAQKFQGRVTITADESTSTAYMELSSLRSEDTAVYYCARANQHFSQAGRAARVPGPSSSLGPRGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 45 - protein, 499 aa, Artificial Sequence
  Description of Artificial Sequence: Synthetic polypeptide
MEWSWVFLFFLSVTTGVHSQVQLVESGGGVVQPGRSLRLSCAASGFDFSNYGMHWVRQAPGKGLEWVADISYEGSNKYYADSVKGRFTISRDNSKNTLYLQMNSLRAEDTAVYYCAKHMSMQSQGLDNLAARDFINWLIQTKITDGFELSRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 46 - protein, 504 aa, Artificial Sequence
  Description of Artificial Sequence: Synthetic polypeptide
MEWSWVFLFFLSVTTGVHSQVQLVQSGAEVKKPGSSVKVSCKASGGTFNNYGISWVRQAPGQGLEWMGGIIPVFGTANYAQKFQGRVTITADESTSTAYMELSSLRSEDTAVYYCARDMYYDFFGLGTFTSDVSSYLEGQAAKEFIAWLVKGVSPEVVPADDAFDIWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 47 - protein, 507 aa, Artificial Sequence
  Description of Artificial Sequence: Synthetic polypeptide
MEWSWVFLFFLSVTTGVHSQVQLVQSGAEVKKPGSSVKVSCKASGGTFSDYAISWVRQAPGQGLEWMGGIIPIFGTTNYAQKFQGRVTITADESTSTAYMELSSLRSEDTAVYYCAKHMSMQGSVAGGTFTSDVSSYLEGQAAKEFIAWLVKGGPSFIRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 48 - protein, 504 aa, Artificial Sequence
  Description of Artificial Sequence: Synthetic polypeptide
MEWSWVFLFFLSVTTGVHSQVQLVQSGAEVKKPGSSVKVSCKASGGTFSSYEISWVRQAPGQGLEWMGGIIPILGIANYAQKFQGRVTITADESTSTAYMELSSLRSEDTAVYYCAKHMSMQADTGTFTSDVSSYLEGQAAKEFIAWLVKGEFSSRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 49 - protein, 496 aa, Artificial Sequence
  Description of Artificial Sequence: Synthetic polypeptide
MEWSWVFLFFLSVTTGVHSQVQLVQSGAEVKKPGSSVKVSCKASGGTFSTYGINWVRQAPGQGLEWMGGIIPIFGTANYAQKFQGRVTITADESTSTAYMELSSLRSEDTAVYYCARANQHFFGKGDNLAARDFINWLIQTKITDGSNPGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 50 - protein, 494 aa, Artificial Sequence
  Description of Artificial Sequence: Synthetic polypeptide
MEWSWVFLFFLSVTTGVHSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARANQHFAATGAGEGQAAKEFIAWLVKGRVEIGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 51 - protein, 471 aa, Artificial Sequence
  Description of Artificial Sequence: Synthetic polypeptide
QVQLVESGGGVVQPGRSLRLSCAASGFTFSNYGMSWVRQAPGKGLEWVAVISYDAGNKYYADSVKGRFTISRDNSKNTLYLQMNSLRAEDTAVYYCARDMYYDFETVVEGIQWYEALKAGKLGEVVPADDAFDIWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 52 - protein, 488 aa, Artificial Sequence
  Description of Artificial Sequence: Synthetic polypeptide
QVQLVQSGAEVKKPGSSVKVSCKASGGTFSDYAISWVRQAPGQGLEWMGGIIPIFGTTNYAQKFQGRVTITADESTSTAYMELSSLRSEDTAVYYCAKHMSMQGSVAGGTFTSDVSSYLEGQAAKEFIAWLVKGGPSFIRADLVGDAFDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 53 - protein, 477 aa, Artificial Sequence
  Description of Artificial Sequence: Synthetic polypeptide
QVQLVQSGAEVKKPGSSVKVSCKASGGTFSTYGINWVRQAPGQGLEWMGGIIPIFGTANYAQKFQGRVTITADESTSTAYMELSSLRSEDTAVYYCARANQHFFGKGDNLAARDFINWLIQTKITDGSNPGYHYYGMDVWGQGTLVTVSSASASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 54 - protein, 474 aa, Artificial Sequence
  Description of Artificial Sequence: Synthetic polypeptide
QVQLVESGGGVVQPGRSLRLSCAASGFTFSSYGMHWVRQAPGKGLEWVSFISYDESNKYYADSVKGRFTISRDNSKNTLYLQMNSLRAEDTAVYYCAKHMSMQEGAVTGEGQAAKEFIAWLVKGRVRADLVGDAFDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 55 - protein, 375 aa, Artificial Sequence
  Description of Artificial Sequence: Synthetic polypeptide
MEWSWVFLFFLSVTTGVHSEVQLVESGGGLVQAGGSLRLSCAASGSIFRINAMGWFRQAPGKEREGVAAINNFGTTKYADSAKGRFTISADNAKNTVYLQMNSLKPEDTAVYYCAAVRWGPHNDDRYDWGQGTQVTVSSGGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 56 - protein, 147 aa, Artificial Sequence
  Description of Artificial Sequence: Synthetic polypeptide
QVQLVESGGGVVQPGRSLRLSCAASGFTFSNYDMHWVRQAPGKGLEWVAVISYEGSDKYYADSVKGRFTISRDNSKNTLYLQMNSLRAEDTAVYYCARANQHFFVPGSLKVWLKGVAPESSSEYDSSEDSGGAFDIWGQGTLVTVSS

SEQ ID NO: 57 - protein, 146 aa, Artificial Sequence
  Description of Artificial Sequence: Synthetic polypeptide
QVQLVQSGAEVKKPGSSVKVSCKASGGTRSNYAINWVRQAPGQGLEWMGGIIPILGTADYAQKFQGRVTITADESTSTAYMELSSLRSEDTAVYYCAKHMSMQEGVLQGQIPSTIDWEGLLHLIRADLVGDAFDVWGQGTLVTVSS

SEQ ID NO: 58 - protein, 148 aa, Artificial Sequence
  Description of Artificial Sequence: Synthetic polypeptide
QVQLVESGGGVVQPGRSLRLSCAASGFTFNNYAMHWVRQAPGKGLEWVAVISYDRSNEYYADSVKGRFTISRDNSKNTLYLQMNSLRAEDTAVYYCAKHMSMQEGAVTGDGQAAKEFIAWLVKGRVRADLVGDAFDVWGQGTLVTVSS

SEQ ID NO: 59 - protein, 148 aa, Artificial Sequence
  Description of Artificial Sequence: Synthetic polypeptide
QVQLVESGGGVVQPGRSLRLSCAASGFTFSNYPMHWVRQAPGKGLEWVAVISYDETNKYYADSVKGRFTISRDNSKNTLYLQMNSLRAEDTAVYYCAKHMSMQEGAVTGEGQAAKEFIAWLVKGIVRADLVGDAFDVWGQGTLVTVSS

SEQ ID NO: 60 - protein, 148 aa, Artificial Sequence
  Description of Artificial Sequence: Synthetic polypeptide
QVQLVESGGGVVQPGRSLRLSCAASGFTFSDYGVHWVRQAPGKGLEWVAFISYDESNKYYADSVKGRFTISRDNSKNTLYLQMNSLRAEDTAVYYCAKHMSMQEGAVTGEYQAAKEFIAWLVKGRVRADLVGDAFDVWGQGTLVTVSS

SEQ ID NO: 61 - protein, 148 aa, Artificial Sequence
  Description of Artificial Sequence: Synthetic polypeptide
QVQLVESGGGVVQPGRSLRLSCAASGFSFSNYAMHWVRQAPGKGLEWVAVISHDRSNKYYADSVKGRFTISRDNSKNTLYLQMNSLRAEDTAVYYCAKHMSMQEGAVTGEGQAAKDFIAWLVKGRVRADLVGDAFDVWGQGTLVTVSS

SEQ ID NO: 62 - protein, 148 aa, Artificial Sequence
  Description of Artificial Sequence: Synthetic polypeptide
QVQLVESGGGVVQPGRSLRLSCAASGFTFNNYPMHWVRQAPGKGLEWVAVISYDETNKYYADSVKGRFTISRDNSKNTLYLQMNSLRAEDTAVYYCAKHMSMQEGAVTGEGQAAKEFIAWLVKGIVRADLVGDAFDVWGQGTLVTVSS

SEQ ID NO: 63 - protein, 148 aa, Artificial Sequence
  Description of Artificial Sequence: Synthetic polypeptide
QVQLVESGGGVVQPGRSLRLSCAASGFIFNNYGMHWVRQAPGKGLEWVAFISYGGSNKYYADSVKGRFTISRDNSKNTLYLQMNSLRAEDTAVYYCAKHMSMQEGAVTGEGQAVKEFIAWLVKGRVRADLVGDAFDVWGQGTLVTVSS

SEQ ID NO: 64 - protein, 148 aa, Artificial Sequence
  Description of Artificial Sequence: Synthetic polypeptide
QVQLVESGGGVVQPGRSLRLSCAASGFPFSNYGMHWVRQAPGKGLEWVAVISHDRSNKYYADSVKGRFTISRDNSKNTLYLQMNSLRAEDTAVYYCAKHMSMQEGAVTGEGQAVKEFIAWLVKGRVRADLVGDAFDVWGQGTLVTVSS

SEQ ID NO: 65 - protein, 148 aa, Artificial Sequence
  Description of Artificial Sequence: Synthetic polypeptide
QVQLVESGGGVVQPGRSLRLSCAASGFTFNNYAMHWVRQAPGKGLEWVAVISYDRSNEYYADSVKGRFTISRDNSKNTLYLQMNSLRAEDTAVYYCAKHMSMQEGAVTGEGQAIKEFIAWLVKGRVRADLVGDAFDVWGQGTLVTVSS

SEQ ID NO: 66 - protein, 148 aa, Artificial Sequence
  Description of Artificial Sequence: Synthetic polypeptide
QVQLVESGGGVVQPGRSLRLSCAASGFAFSNYGMHWVRQAPGKGLEWVAVISSDENNKYYADSVKGRFTISRDNSKNTLYLQMNSLRAEDTAVYYCAKHMSMQEGAVTGEMQAAKEFIAWLVKGRVRADLVGDAFDVWGQGTLVTVSS

SEQ ID NO: 67 - protein, 148 aa, Artificial Sequence
  Description of Artificial Sequence: Synthetic polypeptide
QVQLVESGGGVVQPGRSLRLSCAASGFIFSNYGMHWVRQAPGKGLEWVAVISDEGSNKYYADSVKGRFTISRDNSKNTLYLQMNSLRAEDTAVYYCAKHMSMQEGAVTGAGQAAKEFIAWLVKGRVRADLVGDAFDVWGQGTLVTVSS

SEQ ID NO: 68 - protein, 148 aa, Artificial Sequence
  Description of Artificial Sequence: Synthetic polypeptide
QVQLVESGGGVVQPGRSLRLSCAASGFTFNNYPMHWVRQAPGKGLEWVAVISYDESNKYYADSVKGRFTISRDNSKNTLYLQMNSLRAEDTAVYYCAKHMSMQEGAVTGGGQAAKEFIAWLVKGRVRADLVGDAFDVWGQGTLVTVSS

SEQ ID NO: 69 - protein, 148 aa, Artificial Sequence
  Description of Artificial Sequence: Synthetic polypeptide
QVQLVESGGGVVQPGRSLRLSCAASGFTFNNYAMHWVRQAPGKGLEWVAVISDEGSNKYYADSVKGRFTISRDNSKNTLYLQMNSLRAEDTAVYYCAKHMSMQEGAVTGEYQAAKEFIAWLVKGRVRADLVGDAFDVWGQGTLVTVSS

SEQ ID NO: 70 - protein, 148 aa, Artificial Sequence
  Description of Artificial Sequence: Synthetic polypeptide
QVQLVESGGGVVQPGRSLRLSCAASGFSFSDYGMHWVRQAPGKGLEWVAFISYDANNKYYADSVKGRFTISRDNSKNTLYLQMNSLRAEDTAVYYCAKHMSMQEGAVTGEWQAAKEFIAWLVKGRVRADLVGDAFDVWGQGTLVTVSS

SEQ ID NO: 71 - protein, 148 aa, Artificial Sequence
  Description of Artificial Sequence: Synthetic polypeptide
QVQLVESGGGVVQPGRSLRLSCAASGFAFSNYGMHWVRQAPGKGLEWVSFISYDESNKYYADSVKGRFTISRDNSKNTLYLQMNNLRAEDTAVYYCAKHMSMQEGAVTGEWQAAKEFIAWLVKGRVRADLVGDAFDVWGQGTLVTVSS

SEQ ID NO: 72 - protein, 148 aa, Artificial Sequence
  Description of Artificial Sequence: Synthetic polypeptide
QVQLVESGGGVVQPGRSLRLSCAASGFSFSDYGIHWVRQAPGKGLEWVALISYEGSNKYYADSVKGRFTISRDNSKNTLYLQMNSLRAEDTAVYYCAKHMSMQEGAVTGEKQAAKEFIAWLVKGRVRADLVGDAFDVWGQGTLVTVSS

SEQ ID NO: 73 - protein, 148 aa, Artificial Sequence
  Description of Artificial Sequence: Synthetic polypeptide
QVQLVESGGGVVQPGRSLRLSCAASGFTFRDYGMHWVRQAPGKGLEWVAFIRYDEINKYYADSVKGRFTISRDNSKNTLYLQMNSLRAEDTAVYYCAKHMSMQEGAVTGEGQAAKEFIAWLVGGRVRADLVGDAFDVWGQGTLVTVSS

SEQ ID NO: 74 - protein, 148 aa, Artificial Sequence
  Description of Artificial Sequence: Synthetic polypeptide
QVQLVESGGGVVQPGRSLRLSCAASGFTFNNYGMHWVRQAPGKGLEWVAVISDEGSNKYYADSVKGRFTISRDNSKNTLYLQMNSLRAEDTAVYYCAKHMSMQEGAVTGVGQAAKEFIAWLVKGRVRADLVGDAFDVWGQGTLVTVSS

SEQ ID NO: 75 - protein, 148 aa, Artificial Sequence
  Description of Artificial Sequence: Synthetic polypeptide
QVQLVESGGGVVQPGRSLRLSCAASGFTFSAYSMHWVRQAPGKGLEWVALISYDATNKYYADSVKGRFTISRDNSKNTLYLQMNSLRAEDTAVYYCAKHMSMQEGAVTGEFQAAKEFIAWLVKGRVRADLVGDAFDVWGQGTLVTVSS

SEQ ID NO: 76 - protein, 148 aa, Artificial Sequence
  Description of Artificial Sequence: Synthetic polypeptide
QVQLVESGGGVVQPGRSLRLSCAASGFTFDNYALHWVRQAPGKGLEWVALISYDAGNKYYADSVKGRFTISRDNSKNTLYLQMNSLRAEDTAVYYCAKHMSMQEGAVTGEGQAAKEFIAWLVKGFVRADLVGDAFDVWGQGTLVTVSS

SEQ ID NO: 77 - protein, 148 aa, Artificial Sequence
  Description of Artificial Sequence: Synthetic polypeptide
QVQLVESGGGVVQPGRSLRLSCAASGFPFSSYAMHWVRQAPGKGLEWVAVISYDRSNKYYADSVKGRFTISRDNSKNTLYLQMNSLRAEDTAVYYCAKHMSMQEGAVTGYGQAAKEFIAWLVKGFVRADLVGDAFDVWGQGTLVTVSS

SEQ ID NO: 78 - protein, 203 aa, Artificial Sequence
  Description of Artificial Sequence: Synthetic polypeptide
MSVPTQVLGLLLLWLTDARCQSVLTQPPSVSAAPGQKVTISCSGSTSNIANNYVSWYQQLPGTAPKLLIYANNRRPSGIPDRFSGSKSGTSATLGITGLQTGDEADYYCGAWDVRLDVGVFGGGTKLTVLGQPKAAPSVTLFPPSSEELQANKATLVCLISDFYPGAVTVAWKADSSPVKAGVETTTPSKQSNNKYAASSYLS

SEQ ID NO: 79 - protein, 236 aa, Artificial Sequence
  Description of Artificial Sequence: Synthetic polypeptide
MSVPTQVLGLLLLWLTDARCQSVLTQPPSVSAAPGQKVTISCSGSTSNIEKNYVSWYQQLPGTAPKLLIYGNDQRPSGIPDRFSGSKSGTSATLGITGLQTGDEADYYCGTWENRLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 80 - protein, 236 aa, Artificial Sequence
  Description of Artificial Sequence: Synthetic polypeptide
MSVPTQVLGLLLLWLTDARCQSVLTQPPSVSAAPGQKVTISCSGSSSSIGNNYVSWYQQLPGTAPKLLIYANNKRPSGIPDRFSGSKSGTSATLGITGLQTGDEADYYCATWSSSPRGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 81 - protein, 236 aa, Artificial Sequence
  Description of Artificial Sequence: Synthetic polypeptide
MSVPTQVLGLLLLWLTDARCQSVLTQPPSVSAAPGQKVTISCSGISSNIGNNYVSWYQQLPGTAPKLLIYDDDQRPSGIPDRFSGSKSGTSATLGITGLQTGDEADYYCGTWDNILSAAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 82 - protein, 236 aa, Artificial Sequence
  Description of Artificial Sequence: Synthetic polypeptide
MSVPTQVLGLLLLWLTDARCQSVLTQPPSVSAAPGQKVTISCSGSSSNIENNDVSWYQQLPGTAPKLLIYGNDQRPSGIPDRFSGSKSGTSATLGITGLQTGDEADYYCGTWDNTLSAGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 83 - protein, 235 aa, Artificial Sequence
  Description of Artificial Sequence: Synthetic polypeptide
MSVPTQVLGLLLLWLTDARCQSVLTQPPSVSAAPGQKVTISCSGSRSNIGKNYVSWYQQLPGTAPKLLIYENNERPSGIPDRFSGSKSGTSATLGITGLQTGDEADYYCSSYTTSNTQVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 84 - protein, 236 aa, Artificial Sequence
  Description of Artificial Sequence: Synthetic polypeptide
MSVPTQVLGLLLLWLTDARCQSVLTQPPSVSAAPGQKVTISCSGSSSNIGNNVVSWYQQLPGTAPKLLIYDNDKRRSGIPDRFSGSKSGTSATLGITGLQTGDEADYYCGSWDTSLSVWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 85 - protein, 261 aa, Artificial Sequence
  Description of Artificial Sequence: Synthetic polypeptide
HAEGTFTSDVSSYLEGQAAKEFIAWLVKGRGGGGGSGGGGSGGGGSQSVLTQPPSVSAAPGQKVTISCSGSRSNIGKNYVSWYQQLPGTAPKLLIYENNERPSGIPDRFSGSKSGTSATLGITGLQTGDEADYYCSSYTTSNTQVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 86 - protein, 262 aa, Artificial Sequence
  Description of Artificial Sequence: Synthetic polypeptide
HAEGTFTSDVSSYLEGQAAKEFIAWLVKGRGGGGGSGGGGSGGGGSQSVLTQPPSVSAAPGQKVTISCSGISSNIGNNYVSWYQQLPGTAPKLLIYDDDQRPSGIPDRFSGSKSGTSATLGITGLQTGDEADYYCGTWDNILSAAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 87 - protein, 262 aa, Artificial Sequence
  Description of Artificial Sequence: Synthetic polypeptide
HGEGTFTSDVSSYLEEQAAKEFIAWLVKGGGGGGGSGGGGSGGGGSQSALTQPASVSGSPGQSITISCTGTSNDIGTYNYVSWYQQHPGKAPKLMIYDVSGRPSGVSNRFSGSKSGNTASLTISGLQAEDEADYYCSSYTTSSTEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 88 - protein, 262 aa, Artificial Sequence
  Description of Artificial Sequence: Synthetic polypeptide
HAEGTFTSDVSSYLEGQAAKEFIAWLVKGRGGGGGSGGGGSGGGGSQSALTQPASVSGSPGQSITISCTGTSNDIGTYNYVSWYQQHPGKAPKLMIYDVSGRPSGVSNRFSGSKSGNTASLTISGLQAEDEADYYCSSYTTSSTEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 89 - protein, 216 aa, Artificial Sequence
  Description of Artificial Sequence: Synthetic polypeptide
QSVLTQPPSVSAAPGQKVTISCSGSSSNIADNYVSWYQQLPGTAPKLLIYDNNKRPSGIPDRFSGSKSGTSATLGITGLQTGDEADYYCGTWDNYLGAGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 90 - protein, 109 aa, Artificial Sequence
  Description of Artificial Sequence: Synthetic polypeptide
EIVMTQSPATLSVSPGERATLSCRASHSVSSDLAWYQQKPGQAPRLLIYSASSRATGIPARFSGSGSGTEFTLTISSLQSEDFAVYYCQQYNNWPPASTFGGGTKVEIK

SEQ ID NO: 91 - protein, 106 aa, Artificial Sequence
  Description of Artificial Sequence: Synthetic polypeptide
EIVMTQSPATLSVSPGERATLSCSASQSVSTKLAWYQQKPGQAPRLLIYGASTRAKGIPARFSGSGSGTEFTLTISLQSEDFAVYYCQHYHNWPLTFGGGTKVEIK

SEQ ID NO: 92 - protein, 110 aa, Artificial Sequence
  Description of Artificial Sequence: Synthetic polypeptide
QSVLTQPPSVSAAPGQKVTISCSGTTSNIANNFVSWYQQLPGTAPKLLIYDHNKRPSGIPDRFSGSKSGTSATLGITGLQTGDEADYYCGTWDTSLSAGAFGGGTKLTVL

SEQ ID NO: 93 - protein, 110 aa, Artificial Sequence
  Description of Artificial Sequence: Synthetic polypeptide
QSVLTQPPSVSAAPGQKVTISCSGSGSNIGNNDVSWYQQLPGTAPKLLIYDNDKRPAGIPDRFSGSKSGTSATLGITGLQTGDEADYYCGTWDTSLSNYVFGGGTKLTVL

SEQ ID NO: 94 - protein, 110 aa, Artificial Sequence
  Description of Artificial Sequence: Synthetic polypeptide
QSVLTQPPSVSAAPGQKVTISCSGSSSNIGNTYVSWYQQLPGTAPKLLIYDDYKRPSGIPDRFSGSKSGTSATLGITGLQTGDEADYYCATWDATLNTGVFGGGTKLTVL

SEQ ID NO: 95 - protein, 110 aa, Artificial Sequence
  Description of Artificial Sequence: Synthetic polypeptide
QSVLTQPPSVSAAPGQKVTISCSGSSSNIGNEYVSWYQQLPGTAPKLLIYDNNKRVSGIPDRFSGSKSGTSATLGITGLQTGDEADYYCATWDTSLNVGVFGGGTKLTVL

SEQ ID NO: 96 - protein, 110 aa, Artificial Sequence
  Description of Artificial Sequence: Synthetic polypeptide
QSVLTQPPSVSAAPGQKVTISCSGTSSNIGNNDVSWYQQLPGTAPKLLIYENNKRHSGIPDRFSGSKSGTSATLGITGLQTGDEADYYCLTWDHSLTAYVFGGGTKLTVL

SEQ ID NO: 97 - protein, 110 aa, Artificial Sequence
  Description of Artificial Sequence: Synthetic polypeptide
QSVLTQPPSVSAAPGQKVTISCSGTTSNIANNFVSWYQQLPGTAPKLLIYDNNKRPPGIPDRFSGSKSGTSATLGITGLQTGDEADYYCGTWDTSLSVGMFGGGTKLTVL

SEQ ID NO: 98 - protein, 110 aa, Artificial Sequence
  Description of Artificial Sequence: Synthetic polypeptide
QSVLTQPPSVSAAPGQKVTISCSGSSSNIGNNPVSWYQQLPGTAPKLLIYENDNRPSGIPDRFSGSKSGTSATLGITGLQTGDEADYYCATWDRGLSTGVFGGGTKLTVL

SEQ ID NO: 99 - protein, 110 aa, Artificial Sequence
  Description of Artificial Sequence: Synthetic polypeptide
QSVLTQPPSVSAAPGQKVTISCSGSSSNIGNNYLSWYQQLPGTAPKLLIYENNKRPSGIPDRFSGSKSGTSATLGITGLQTGDEADYYCGIWDRSLSAWVFGGGTKLTVL

SEQ ID NO: 100 - protein, 110 aa, Artificial Sequence
  Description of Artificial Sequence: Synthetic polypeptide
QSVLTQPPSVSAAPGQKVTISCSGSSSNIADNYVSWYQQLPGTAPKLLIYENNRRPSGIPDRFSGSKSGTSATLGITGLQTGDEADYYCGTWDVSLSVGMFGGGTKLTVL

SEQ ID NO: 101 - protein, 110 aa, Artificial Sequence
  Description of Artificial Sequence: Synthetic polypeptide
QSVLTQPPSVSAAPGQKVTISCSGSSSNIGNQYVSWYQQLPGTAPKLLIYDDHKRPSGIPDRFSGSKSGTSATLGITGLQTGDEADYYCGTWDTSLSVGEFGGGTKLTVL

SEQ ID NO: 102 - protein, 110 aa, Artificial Sequence
  Description of Artificial Sequence: Synthetic polypeptide
QSVLTQPPSVSAAPGQKVTISCSGSSSNIGKRSVSWYQQLPGTAPKLLIYDNNKRASGIPDRFSGSKSGTSATLGITGLQTGDEADYYCVTWDRSLSAGVFGGGTKLTVL

SEQ ID NO: 103 - protein, 110 aa, Artificial Sequence
  Description of Artificial Sequence: Synthetic polypeptide
QSVLTQPPSVSAAPGQKVTISCSGSSSNIENNDVSWYQQLPGTAPKLLIYDFNKRPSGIPDRFSGSKSGTSATLGITGLQTGDEADYYCGTWDTSLSVGMFGGGTKLTVL

SEQ ID NO: 104 - protein, 110 aa, Artificial Sequence
  Description of Artificial Sequence: Synthetic polypeptide
QSVLTQPPSVSAAPGQKVTISCSGSSSNIGNNDVSWYQQLPGTAPKLLIYENTKRPSGIPDRFSGSKSGTSATLGITGLQTGDEADYYCGTWDAGLSTGVFGGGTKLTVL

SEQ ID NO: 105 - protein, 110 aa, Artificial Sequence
  Description of Artificial Sequence: Synthetic polypeptide
QSVLTQPPSVSAAPGQKVTISCSGSSSNIGNHDVSWYQQLPGTAPKLLIYDNNKRHSGIPDRFSGSKSGTSATLGITGLQTGDEADYYCGTWDTSLSAGVFGGGTKLTVL

SEQ ID NO: 106 - protein, 110 aa, Artificial Sequence
  Description of Artificial Sequence: Synthetic polypeptide
QSVLTQPPSVSAAPGQKVTISCSGSSSNIADNYVSWYQQLPGTAPKLLIYDNNKRASGIPDRFSGSKSGTSATLGITGLQTGDEADYYCATWDNRLSAGVFGGGTKLTVL

SEQ ID NO: 107 - protein, 110 aa, Artificial Sequence
  Description of Artificial Sequence: Synthetic polypeptide
QSVLTQPPSVSAAPGQKVTISCSGSGSNIGNNDVSWYQQLPGTAPKLLIYDNNKRASGIPDRFSGSKSGTSATLGITGLQTGDEADYYCGTWDRGPNTGVFGGGTKLTVL

SEQ ID NO: 108 - protein, 110 aa, Artificial Sequence
  Description of Artificial Sequence: Synthetic polypeptide
QSVLTQPPSVSAAPGQKVTISCSGSSSNIGNNDVSWYQQLPGTAPKLLIYDDDKRPSGIPDRFSGSKSGTSATLGITGLQTGDEADYYCGTWDTSLSVGEFGGGTKLTVL

SEQ ID NO: 109 - protein, 110 aa, Artificial Sequence
  Description of Artificial Sequence: Synthetic polypeptide
QSVLTQPPSVSAAPGQKVTISCSGSSSNIGSKYVSWYQQLPGTAPKLLIYDNNKRPSGIPDRFSGSKSGTSATLGITGLQTGDEADYYCGTWDISPSAWVFGGGTKLTVL

SEQ ID NO: 110 - protein, 110 aa, Artificial Sequence
  Description of Artificial Sequence: Synthetic polypeptide
QSVLTQPPSVSAAPGQKVTISCSGSSSNIGSDYVSWYQQLPGTAPKLLIYDNNKRSSGIPDRFSGSKSGTSATLGITGLQTGDEADYYCGTWDESLRSWVFGGGTKLTVL

SEQ ID NO: 111 - protein, 110 aa, Artificial Sequence
  Description of Artificial Sequence: Synthetic polypeptide
QSVLTQPPSVSAAPGQKVTISCSGSSSNIGSNYISWYQQLPGTAPKLLIYDNDKRPAGIPDRFSGSKSGTSATLGITGLQTGDEADYYCGTWDTSLSVGEFGGGTKLTVL

SEQ ID NO: 112 - protein, 116 aa, Artificial Sequence
  Description of Artificial Sequence: Synthetic polypeptide
EVQLVESGGGLVQPGGSLRLSCAASGFTCGDYTMGWFRQAPGKEREFLAAITSGGATTYDDNRKSRFTISADNSKNTAYLQMNSLKPEDTAVYYCWAALDGYGGRWGQGTLVTVSS

SEQ ID NO: 113 - protein, 116 aa, Artificial Sequence
  Description of Artificial Sequence: Synthetic polypeptide
EVQLVESGGGLVQPGGSLRLSCAASGRTFRINRMGWFRQAPGKEREWVSTICSRGDTYYADSVKGRFTISADNSKNTAYLQMNSLKPEDTAVYYCAATLDGYSGSWGQGTLVTVSS

SEQ ID NO: 114 - protein, 115 aa, Artificial Sequence
  Description of Artificial Sequence: Synthetic polypeptide
EVQLVESGGGLVQPGGSLRLSCAASGRDFRVKNMGWFRQAPGKEREFVARITWNGGSAYYADSVKGRFTISADNSKNTAYLQMNSLKPEDTAVYYCAARILSRNWGQGTLVTVSS

SEQ ID NO: 115 - protein, 116 aa, Artificial Sequence
  Description of Artificial Sequence: Synthetic polypeptide
EVQLVESGGGLVQPGGSLRLSCAASGFTFSFYTMGWFRQAPGKEREFVAAISSGGRTSYADSVKGRFTISADNSKNTAYLQMNSLKPEDTAVYYCAAALDGYEGSWGQGTLVTVSS

SEQ ID NO: 116 - protein, 116 aa, Artificial Sequence
  Description of Artificial Sequence: Synthetic polypeptide
EVQLVESGGGLVQPGGSLRLSCAASGFTFSFYAMGWFRQAPGKEREFVAAISSGGRTRYADNVKGRFTISADNSKNTAYLQMNSLKPEDTAVYYCSAALDGYNGIWGQGTLVTVSS

SEQ ID NO: 117 - protein, 123 aa, Artificial Sequence
  Description of Artificial Sequence: Synthetic polypeptide
EVQLVESGGGLVQPGGSLRLSCAASGHTSDTYIMGWFRQAPGKEREFVSLINWSSGKTIYADSVKGRFTISADNSKNTAYLQMNSLKPEDTAVYYCAKGDYRGGYYYPQTSQWGQGTLVTVSS

SEQ ID NO: 118 - protein, 116 aa, Artificial Sequence
  Description of Artificial Sequence: Synthetic polypeptide
EVQLVESGGGLVQPGGSLRLSCAASGFTFSSYPMGWFRQAPGKEREFVATIPSGGSTYYADSVKGRFTISADNSKNTAYLQMNSLKPEDTAVYYCAAALDGYNGSWGQGTLVTVSS

SEQ ID NO: 119 - protein, 116 aa, Artificial Sequence
  Description of Artificial Sequence: Synthetic polypeptide
EVQLVESGGGLVQPGGSLRLSCAASGFTFGEFTMGWFRQAPGKERERVATITSGGSTNYADSVKGRFTISADNSKNTAYLQMNSLKPEDTAVYYCAAVVDDYSGSWGQGTLVTVSS

SEQ ID NO: 120 - protein, 117 aa, Artificial Sequence
  Description of Artificial Sequence: Synthetic polypeptide
EVQLVESGGGLVQPGGSLRLSCAASGFTDGIDAMGWFRQAPGKEREVVAGIAWGDGITYYADSVKGRFTISADNSKNTAYLQMNSLKPEDTAVYYCAASYNVYYNNWGQGTLVTVSS

SEQ ID NO: 121 - protein, 122 aa, Artificial Sequence
  Description of Artificial Sequence: Synthetic polypeptide
EVQLVESGGGLVQPGGSLRLSCAASGRTFSSGVMGWFRQAPGKEREFVAAINRSGSTFYADSVKGRFTISADNSKNTAYLQMNSLKPEDTAVYYCAKTKRTGIFTTARMVDWGQGTLVTVSS

SEQ ID NO: 122 - protein, 126 aa, Artificial Sequence
  Description of Artificial Sequence: Synthetic polypeptide
EVQLVESGGGLVQPGGSLRLSCAASGVTLDDYAMGWFRQAPGKEREFVAAINRSGSITYYADSVKGRFTISADNSKNTAYLQMNSLKPEDTAVYYCAAYYTDYDEALEETRGSYDWGQGTLVTVSS

SEQ ID NO: 123 - protein, 121 aa, Artificial Sequence
  Description of Artificial Sequence: Synthetic polypeptide
EVQLVESGGGLVQPGGSLRLSCAASGLTFGIYAMGWFRQAPGKEREFVATISRSGASTYYADSVKGRFTISADNSKNTAYLQMNSLKPEDTAVYYCAAIVTYNDYDRGHDWGQGTLVTVSS

SEQ ID NO: 124 - protein, 122 aa, Artificial Sequence
  Description of Artificial Sequence: Synthetic polypeptide
EVQLVESGGGLVQPGGSLRLSCAASGFTFSSDGMGWFRQAPGKERELVAAINRSGSTFYADSVKGRFTISADNSKNTAYLQMNSLKPEDTAVYYCAKTARPGIFTTAPVEDWGQGTLVTVSS

SEQ ID NO: 125 - protein, 116 aa, Artificial Sequence
  Description of Artificial Sequence: Synthetic polypeptide
EVQLVESGGGLVQPGGSLRLSCAASGFTCGNYTMGWFRQAPGKERESVASITSGGRTNYADSVKGRFTISADNSKNTAYLQMNSLKPEDTAVYYCAATLDGYTGSWGQGTLVTVSS

SEQ ID NO: 126 - protein, 116 aa, Artificial Sequence
  Description of Artificial Sequence: Synthetic polypeptide
EVQLVESGGGLVQPGGSLRLSCAASGFTFNYYPMGWFRQAPGKEREWVATISRGGGTYYADNVKGRFTISADNSKNTAYLQMNSLKPEDTAVYYCSAALDGYSGIWGQGTLVTVSS

SEQ ID NO: 127 - protein, 123 aa, Artificial Sequence
  Description of Artificial Sequence: Synthetic polypeptide
EVQLVESGGGLVQPGGSLRLSCAASGIIGSFRTMGWFRQAPGKEREFVGFITGSGGTTYYADSVKGRFTISADNSKNTAYLQMNSLKPEDTAVYYCAAARRYGNLYNTNNYDWGQGTLVTVSS

SEQ ID NO: 128 - protein, 120 aa, Artificial Sequence
  Description of Artificial Sequence: Synthetic polypeptide
EVQLVESGGGLVQPGGSLRLSCAASGITFRFKAMGWFRQAPGKEREFVAAISWRGGSTNYADSVKGRFTISADNSKNTAYLQMNSLKPEDTAVYYCAAATLGEPLVKYTWGQGTLVTVSS

SEQ ID NO: 129 - protein, 124 aa, Artificial Sequence
  Description of Artificial Sequence: Synthetic polypeptide
EVQLVESGGGLVQPGGSLRLSCAASGSFFSINAMGWFRQAPGKEREFVAGISSKGGSSTYYADSVKGRFTISADNSKNTAYLQMNSLKPEDTAVYYCAAHRIVVGGTSVGDWRWGQGTLVTVSS

SEQ ID NO: 130 - protein, 125 aa, Artificial Sequence
  Description of Artificial Sequence: Synthetic polypeptide
EVQLVESGGGLVQPGGSLRLSCAASGSRFSGRFNILNMGWFRQAPGKEREFVAAISRSGDTTYYADSVKGRFTISADNSKNTAYLQMNSLKPEDTAVYYCAASLRNSGSNVEGRWGQGTLVTVSS

SEQ ID NO: 131 - protein, 117 aa, Artificial Sequence
  Description of Artificial Sequence: Synthetic polypeptide
EVQLVESGGGLVQPGGSLRLSCAASGGTSNSYRMGWFRQAPGKEREFVAVISWTGGSTYYADSVKGRFTISADNSKNTAYLQMNSLKPEDTAVYYCAVALDGYSGSWGQGTLVTVSS

SEQ ID NO: 132 - protein, 116 aa, Artificial Sequence
  Description of Artificial Sequence: Synthetic polypeptide
EVQLVESGGGLVQPGGSLRLSCAASGFNIGTYTMGWFRQAPGKEREFVAAIGSNGLANYADNVKGRFTISADNSKNTAYLQMNSLKPEDTAVYYCSAALDGYSGTWGQGTLVTVSS

SEQ ID NO: 133 - protein, 116 aa, Artificial Sequence
  Description of Artificial Sequence: Synthetic polypeptide
EVQLVESGGGLVQPGGSLRLSCAASGRTFSVYAMGWFRQAPGKEREFVAGIHSDGSTLYADSVKGRFTISADNSKNTAYLQMNSLKPEDTAVYYCAAVLDGYMGTWGQGTLVTVSS

SEQ ID NO: 134 - protein, 127 aa, Artificial Sequence
  Description of Artificial Sequence: Synthetic polypeptide
EVQLVESGGGLVQPGGSLRLSCAASGNIKSIDVMGWFRQAPGKERELVAAVRWSGGITWYADSVKGRFTISADNSKNTAYLQMNSLKPEDTAVYYCAAVVYYGDWEGSEPVQHEYDWGQGTLVTVSS

SEQ ID NO: 135 - protein, 114 aa, Artificial Sequence
  Description of Artificial Sequence: Synthetic polypeptide
EVQLVESGGGLVQPGGSLRLSCAASGFTFSNYAMGWFRQAPGKEREFVAAIYCSDGSTQYADSVKGRFTISADNSKNTAYLQMNSLKPEDTAVYYCAEALDGYWGQGTLVTVSS

SEQ ID NO: 136 - protein, 125 aa, Artificial Sequence
  Description of Artificial Sequence: Synthetic polypeptide
EVQLVESGGGLVQPGGSLRLSCAASGYTFRAYAMGWFRQAPGKEREMVAAMRWSGGITWYADSVKGRFTISADNSKNTAYLQMNSLKPEDTAVYYCAAQGSLYDDYDGLPIKYDWGQGTLVTVSS

SEQ ID NO: 137 - protein, 116 aa, Artificial Sequence
  Description of Artificial Sequence: Synthetic polypeptide
EVQLVESGGGLVQPGGSLRLSCAASGLTFSSYAMGWFRQAPGKERECVTAIFSDGGTYYADNVKGRFTISADNSKNTAYLQMNSLKPEDTAVYYCAAALDGYNGYWGQGTLVTVSS

SEQ ID NO: 138 - protein, 125 aa, Artificial Sequence
  Description of Artificial Sequence: Synthetic polypeptide
EVQLVESGGGLVQPGGSLRLSCAASGIHFAISTMGWFRQAPGKEREIVTAINWSGARTYYADSVKGRFTISADNSKNTAYLQMNSLKPEDTAVYYCAAKFVNTDSTWSRSEMYTWGQGTLVTVSS

SEQ ID NO: 139 - protein, 116 aa, Artificial Sequence
  Description of Artificial Sequence: Synthetic polypeptide
EVQLVESGGGLVQPGGSLRLSCAASGLTFTSYAMGWFRQAPGKEREGVAVIDSDGTTYYADSVKGRFTISADNSKNTAYLQMNSLKPEDTAVYYCAAYLDGYSGSWGQGTLVTVSS

SEQ ID NO: 140 - protein, 117 aa, Artificial Sequence
  Description of Artificial Sequence: Synthetic polypeptide
EVQLVESGGGLVQPGGSLRLSCAASGRTFSSLPMGWFRQAPGKERELVAIRWSGGSTVYADSVKGRFTISADNSKNTAYLQMNSLKPEDTAVYYCAAIAYEEGVYRWGQGTLVTVSS

SEQ ID NO: 141 - protein, 117 aa, Artificial Sequence
  Description of Artificial Sequence: Synthetic polypeptide
EVQLVESGGGLVQPGGSLRLSCAASGRTFSSGVMGWFRQAPGKEREFVAAINRSGSTFYADSVKGRFTISADNSKNTAYLQMNSLKPEDTAVYYCAKTKRTGIFTTWGQGTLVTVSS

SEQ ID NO: 142 - protein, 116 aa, Artificial Sequence
  Description of Artificial Sequence: Synthetic polypeptide
EVQLVESGGGLVQPGGSLRLSCAASGFTFSSYAMGWFRQAPGKERELVAAISSGGSTSYADSVKGRFTISADNSKNTAYLQMNSLKPEDTAVYYCAAAMDGYSGSWGQGTLVTVSS

SEQ ID NO: 143 - protein, 123 aa, Artificial Sequence
  Description of Artificial Sequence: Synthetic polypeptide
EVQLVESGGGLVQPGGSLRLSCAASGFTDGIDAMGWFRQAPGKEREYVAAISGSGSITNYADSVKGRFTISADNSKNTAYLQMNSLKPEDTAVYYCAANGIESYGWGNRHFNWGQGTLVTVSS

SEQ ID NO: 144 - protein, 121 aa, Artificial Sequence
  Description of Artificial Sequence: Synthetic polypeptide
EVQLVESGGGLVQPGGSLRLSCAASGFTDGIDAMGWFRQAPGKEREFVAAIRWSGGITWYADSVKGRFTISADNSKNTAYLQMNSLKPEDTAVYYCAAAIFDVTDYERADWGQGTLVTVSS

SEQ ID NO: 145 - protein, 121 aa, Artificial Sequence
  Description of Artificial Sequence: Synthetic polypeptide
EVQLVESGGGLVQPGGSLRLSCAASGFAFSGYAMGWFRQAPGKEREFVAAISWSGGITWYADSVKGRFTISADNSKNTAYLQMNSLKPEDTAVYYCAFVTTNSDYDLGRDWGQGTLVTVSS

SEQ ID NO: 146 - protein, 117 aa, Artificial Sequence
  Description of Artificial Sequence: Synthetic polypeptide
EVQLVESGGGLVQPGGSLRLSCAASGIPASIRTMGWFRQAPGKEREGVSWISSSDGSIYYADSVKGRFTISADNSKNTAYLQMNSLKPEDTAVYYCVAALDGYSGSWGQGTLVTVSS

SEQ ID NO: 147 - protein, 119 aa, Artificial Sequence
  Description of Artificial Sequence: Synthetic polypeptide
EVQLVESGGGLVQPGGSLRLSCAASGRTFSSLPMGWFRQAPGKERELVAIRWSGGSTVYADSVKGRFTISADNSKNTAYLQMNSLKPEDTAVYYCAAIAYEEGVYRWDWGQGTLVTVSS

SEQ ID NO: 148 - protein, 117 aa, Artificial Sequence
  Description of Artificial Sequence: Synthetic polypeptide
EVQLVESGGGLVQPGGSLRLSCAASGFNSGSYTMGWFRQAPGKEREGVSWISTTDGSTYYADSVKGRFTISADNSKNTAYLQMNSLKPEDTAVYYCAAALDGYSGIWGQGTLVTVSS

SEQ ID NO: 149 - protein, 116 aa, Artificial Sequence
  Description of Artificial Sequence: Synthetic polypeptide
EVQLVESGGGLVQPGGSLRLSCAASGFTFSVYAMGWFRQAPGKEREFVTAIDSESRTLYADSVKGRFTISADNSKNTAYLQMNSLKPEDTAVYYCAALLDGYLGTWGQGTLVTVSS

SEQ ID NO: 150 - protein, 122 aa, Artificial Sequence
  Description of Artificial Sequence: Synthetic polypeptide
EVQLVESGGGLVQPGGSLRLSCAASGSVFKINVMGWFRQAPGKEREFLGSILWSDDSTNYADSVKGRFTISADNSKNTAYLQMNSLKPEDTAVYYCAANLKQGSYGYRFNDWGQGTLVTVSS

SEQ ID NO: 151 - protein, 122 aa, Artificial Sequence
  Description of Artificial Sequence: Synthetic polypeptide
EVQLVESGGGLVQPGGSLRLSCAASGTIVNIHVMGWFRQAPGKERELVAAITSGGSTSYADNVKGRFTISADNSKNTAYLQMNSLKPEDTAVYYCAASAIGSGALRHFEYDWGQGTLVTVSS

SEQ ID NO: 152 - protein, 117 aa, Artificial Sequence
  Description of Artificial Sequence: Synthetic polypeptide
EVQLVESGGGLVQPGGSLRLSCAASGRSLGTYHMGWFRQAPGKEREGVSWISSSDGSTYYADSVKGRFTISADNSKNTAYLQMNSLKPEDTAVYYCAVVLDGYSGSWGQGTLVTVSS

SEQ ID NO: 153 - protein, 124 aa, Artificial Sequence
  Description of Artificial Sequence: Synthetic polypeptide
EVQLVESGGGLVQPGGSLRLSCAASGFTFDDTGMGWFRQAPGKEREFVAAIRWSGKETWYADSVKGRFTISADNSKNTAYLQMNSLKPEDTAVYYCAAEDPSMYYTLEEYEYDWGQGTLVTVSS

SEQ ID NO: 154 - protein, 117 aa, Artificial Sequence
  Description of Artificial Sequence: Synthetic polypeptide
EVQLVESGGGLVQPGGSLRLSCAASGFTFSSYVMGWFRQAPGKERECVAAISSSDGRTYYADSVKGRFTISADNSKNTAYLQMNSLKPEDTAVYYCAAALDGYSGNWGQGTLVTVSS

SEQ ID NO: 155 - protein, 119 aa, Artificial Sequence
  Description of Artificial Sequence: Synthetic polypeptide
EVQLVESGGGLVQPGGSLRLSCAASGSIFRVNVMGWFRQAPGKEREFIATIFSGGDTDYADSVKGRFTISADNSKNTAYLQMNSLKPEDTAVYYCAAIAHEEGVYRWDWGQGTLVTVSS

SEQ ID NO: 156 - protein, 116 aa, Artificial Sequence
  Description of Artificial Sequence: Synthetic polypeptide
EVQLVESGGGLVQPGGSLRLSCAASGFTCGDYTMGWFRQAPGKEREIVASITSGGRKNYADSVKGRFTISADNSKNTAYLQMNSLKPEDTAVYYCAAALDDYSGSWGQGTLVTVSS

SEQ ID NO: 157 - protein, 117 aa, Artificial Sequence
  Description of Artificial Sequence: Synthetic polypeptide
EVQLVESGGGLVQPGGSLRLSCAASGHSFGNFPMGWFRQAPGKEREVIAAIDWSGGSTFYADSVKGRFTISADNSKNTAYLQMNSLKPEDTAVYYCAAAKGIGVYGWGQGTLVTVSS

SEQ ID NO: 158 - protein, 125 aa, Artificial Sequence
  Description of Artificial Sequence: Synthetic polypeptide
EVQLVESGGGLVQPGGSLRLSCAASGSSFRFRAMGWFRQAPGKEREFVAAINRGGKISHYADSVKGRFTISADNSKNTAYLQMNSLKPEDTAVYYCAAYIRPDTYLSRDYRKYDWGQGTLVTVSS

SEQ ID NO: 159 - protein, 116 aa, Artificial Sequence
  Description of Artificial Sequence: Synthetic polypeptide
EVQLVESGGGLVQPGGSLRLSCAASGFTWGDYTMGWFRQAPGKEREGVAAIDSDGRTRYADSVKGRFTISADNSKNTAYLQMNSLKPEDTAVYYCAAALDGYSGSWGQGTLVTVSS

SEQ ID NO: 160 - protein, 121 aa, Artificial Sequence
  Description of Artificial Sequence: Synthetic polypeptide
EVQLVESGGGLVQPGGSLRLSCAASGNILSLNTMGWFRQAPGKEREFVAGISWSGGSTYYADSVKGRFTISADNSKNTAYLQMNSLKPEDTAVYYCAAIVTYSDYDLGNDWGQGTLVTVSS

SEQ ID NO: 161 - protein, 117 aa, Artificial Sequence
  Description of Artificial Sequence: Synthetic polypeptide
EVQLVESGGGLVQPGGSLRLSCAASGITFRRYDMGWFRQAPGKEREGVAYISSSDGSTYYADSVKGRFTISADNSKNTAYLQMNSLKPEDTAVYYCAAVLDDYSGGWGQGTLVTVSS

SEQ ID NO: 162 - protein, 118 aa, Artificial Sequence
  Description of Artificial Sequence: Synthetic polypeptide
EVQLVESGGGLVQPGGSLRLSCAASGLTLSNYAMGWFRQAPGKEREFVAAISRSGSSTYYADSVKGRFTISADNSKNTAYLQMNSLKPEDTAVYYCAAEMSGISGWDWGQGTLVTVSS

SEQ ID NO: 163 - protein, 123 aa, Artificial Sequence
  Description of Artificial Sequence: Synthetic polypeptide
EVQLVESGGGLVQPGGSLRLSCAASGYTTSINTMGWFRQAPGKEREVVAAISRTGGSTYYADSVKGRFTISADNSKNTAYLQMNSLKPEDTAVYYCAASAIGSGALRRFEYDWGQGTLVTVSS

SEQ ID NO: 164 - protein, 126 aa, Artificial Sequence
  Description of Artificial Sequence: Synthetic polypeptide
EVQLVESGGGLVQPGGSLRLSCAASGRTFSIDAMGWFRQAPGKEREFVAAIKPDGSITYYADSVKGRFTISADNSKNTAYLQMNSLKPEDTAVYYCAASASDYGLGLELFHDEYNWGQGTLVTVSS

SEQ ID NO: 165 - protein, 117 aa, Artificial Sequence
  Description of Artificial Sequence: Synthetic polypeptide
EVQLVESGGGLVQPGGSLRLSCAASGSIFSLNAMGWFRQAPGKERELVAGISSKGGSTYYADSVKGRFTISADNSKNTAYLQMNSLKPEDTAVYYCAAFRGIMRPDWGQGTLVTVSS

SEQ ID NO: 166 - protein, 117 aa, Artificial Sequence
  Description of Artificial Sequence: Synthetic polypeptide
EVQLVESGGGLVQPGGSLRLSCAASGFTFSSYRMGWFRQAPGKEREAVAAIASMGGLTYYADSVKGRFTISADNSKNTAYLQMNSLKPEDTAVYYCAAALDGYIGSWGQGTLVTVSS

SEQ ID NO: 167 - protein, 116 aa, Artificial Sequence
  Description of Artificial Sequence: Synthetic polypeptide
EVQLVESGGGLVQPGGSLRLSCAASGFTFGAFTMGWFRQAPGKERERVAAITCSGSTTYADSVKGRFTISADNSKNTAYLQMNSLKPEDTAVYYCSAALDGYNGSWGQGTLVTVSS

SEQ ID NO: 168 - protein, 117 aa, Artificial Sequence
  Description of Artificial Sequence: Synthetic polypeptide
EVQLVESGGGLVQPGGSLRLSCAASGIPSTIRAMGWFRQAPGKERESVGRIYWRDDNTYYADSVKGRFTISADNSKNTAYLQMNSLKPEDTAVYYCAAVLDGYSGSWGQGTLVTVSS

SEQ ID NO: 169 - protein, 128 aa, Artificial Sequence
  Description of Artificial Sequence: Synthetic polypeptide
EVQLVESGGGLVQPGGSLRLSCAASGFTDGIDAMGWFRQAPGKEREVVAGIAWGDGITYYADSVKGRFTISADNSKNTAYLQMNSLKPEDTAVYYCAASYNVYYNNYYYPISRDEYDWGQGTLVTVSS

SEQ ID NO: 170 - protein, 116 aa, Artificial Sequence
  Description of Artificial Sequence: Synthetic polypeptide
EVQLVESGGGLVQAGGSLRLSCAASGRTIVPYTMGWFRQAPGKEREVVASISWSGKSTYYADSVRGRFTISADNAKNTVYLQMNSLKPEDTAVYYCAAQRRWSQDWGQGTQVTVSS

SEQ ID NO: 171 - protein, 119 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPTGRGERDYWGQGTQVTVSS

SEQ ID NO: 172 - protein, 119 aa, Artificial Sequence
  Description of Artificial Sequence: Synthetic polypeptide
EVQLVESGGGLVQAGGSLRLSCAASGFTFSNYAMGWFRQAPGKEREFVATITWSGSSTYYADSVKGRFTISADNAKNTVYLQMNSLKPEDTAVYYCAAVPRLYREYGYWGQGTQVTVSS

SEQ ID NO: 173 - protein, 120 aa, Artificial Sequence
  Description of Artificial Sequence: Synthetic polypeptide
EVQLVESGGGLVQAGGSLRLSCAASGSIFHINPMGWFRQAPGKEREFVAAINIFGTTNYADSVKGRFTISADNAKNTVYLQMNSLKPEDTAVYYCAAVDGGPLWDDGYDWGQGTQVTVSS

SEQ ID NO: 174 - protein, 120 aa, Artificial Sequence
  Description of Artificial Sequence: Synthetic polypeptide
EVQLVESGGGLVQAGGSLRLSCAASGSIFRINAMGWFRQAPGKEREGVASINIFGTTKYADSVKGRFTISADNAKNTVYLQMNSLKPEDTAVYYCSAVGWGPHNDDRYDWGQGTQVTVSS

SEQ ID NO: 175 - protein, 118 aa, Artificial Sequence
  Description of Artificial Sequence: Synthetic polypeptide
EVQLVESGGGLVQAGGSLRLSCAASGTTFSIYAMEWFRQAPGKERELVATISRSGGTTYYADSVGGRFTISADNAKNTVYLQMNSLKPEDTAVYYCAAASWYYRDDYWGQGTQVTVSS

SEQ ID NO: 176 - protein, 120 aa, Artificial Sequence
  Description of Artificial Sequence: Synthetic polypeptide
EVQLVESGGGLVQAGGSLRLSCAASGSIFRINAMGWFRQAPGKEREGVAAINNFGTTKYADSVKGRFTISADNAKNTVYLQMNSLKPEDTAVYYCSAVRWGPHNDDRYDWGQGTQVTVSS

SEQ ID NO: 177 - protein, 120 aa, Artificial Sequence
  Description of Artificial Sequence: Synthetic polypeptide
EVQLVESGGGLVQAGGSLRLSCAASGSIFRINAMGWFRQAPGKEREGVAAINNFGTTKYADSAKGRFTISADNAKNTVYLQMNSLKPEDTAVYYCAAVRWGPHNDDRYDWGQGTQVTVSS

SEQ ID NO: 178 - protein, 117 aa, Artificial Sequence
  Description of Artificial Sequence: Synthetic polypeptide
EVQLVESGGGLVQAGGSLRLSCAASGFILYGYAMGWFRQAPGKEREGVSSISPSDASTYYADSVKGRFTISADNAKNTVYLQMNSLKPEDTAVYYCAAVLNTYSDSWGQGTQVTVSS

SEQ ID NO: 179 - protein, 117 aa, Artificial Sequence
  Description of Artificial Sequence: Synthetic polypeptide
EVQLVESGGGLVQAGGSLRLSCAASGRTFSSYAMGWFRQAPGKEREGVTAISTSDGSTYYADSVKGRFTISADNAKNTVYLQMNSLKPEDTAVYYCAAARDGYSGSWGQGTQVTVSS

SEQ ID NO: 180 - protein, 118 aa, Artificial Sequence
  Description of Artificial Sequence: Synthetic polypeptide
EVQLVESGGGLVQAGGSLRLSCAASGYTITNSYRMGWFRQAPGKEREFVAGITMSGFNTRYADSVKGRFTISADNAKNTVYLQMNSLKPEDTAVYYCAANRGLAGPAWGQGTQVTVSS

SEQ ID NO: 181 - protein, 116 aa, Artificial Sequence
  Description of Artificial Sequence: Synthetic polypeptide
EVQLVESGGGLVQAGGSLRLSCAASGFTFDDNAMGWFRQAPGKEREFVSGISTSGSTTYYADSVKGRFTISADNAKNTVYLQMNSLKPEDTAVYYCAAAAGGYDYWGQGTQVTVSS

SEQ ID NO: 182 - protein, 117 aa, Artificial Sequence
  Description of Artificial Sequence: Synthetic polypeptide
EVQLVESGGGLVQAGGSLRLSCAASGRTFSYYHMGWFRQAPGKEREGVSWISSYYSSTYYADSESGRFTISADNAKNTVYLQMNSLKPEDTAVYYCAAVLDGYSCSWGQGTQVTVSS

SEQ ID NO: 183 - protein, 116 aa, Artificial Sequence
  Description of Artificial Sequence: Synthetic polypeptide
EVQLVESGGGLVQAGGSLRLSCAASGSPFRLYTMGWFRQAPGKEREVVAHIYSYGSINYADSVKGRFTISADNAKNTVYLQMNSLKPEDTAVYYCAAALWGHSGDWGQGTQVTVSS

SEQ ID NO: 184 - protein, 119 aa, Artificial Sequence
  Description of Artificial Sequence: Synthetic polypeptide
EVQLVESGGGLVQAGGSLRLSCAASGSTFDTYGMGWFRQAPGKEREFVASITWSGSSTYYADSVKGRFTISADNAKNTVYLQMNSLKPEDTAVYYCAANRIHWSGFYYWGQGTQVTVSS

SEQ ID NO: 185 - protein, 120 aa, Artificial Sequence
  Description of Artificial Sequence: Synthetic polypeptide
EVQLVESGGGLVQAGGSLRLSCAASGRTSSPYTMGWFRQAPGKEREFVSAISWSGGSTVYADSVKGRFTISADNAKNTVYLQMNSLKPEDTAVYYCALIRRAPYSRLETWGQGTQVTVSS

SEQ ID NO: 186 - protein, 120 aa, Artificial Sequence
  Description of Artificial Sequence: Synthetic polypeptide
EVQLVESGGGLVQAGGSLRLSCAASGSIFPINAMGWFRQAPGKEREGVAAITNFGTTKYADSVKGRFTISADNAKNTVYLQMNSLKPEDTAVYYCAAVRWGPRNDDHYDWGQGTQVTVSS

SEQ ID NO: 187 - protein, 119 aa, Artificial Sequence
  Description of Artificial Sequence: Synthetic polypeptide
EVQLVESGGGLVQAGGSLRLSCAASGRTFDTYAMGWFRQAPGKEREFVAAITWGGGRTYYADSVKGRFTISADNAKNTVYLQMNSLKPEDTAVYYCAAVPRLYRDYDYWGQGTQVTVSS

SEQ ID NO: 188 - protein, 116 aa, Artificial Sequence
  Description of Artificial Sequence: Synthetic polypeptide
EVQLVESGGGLVQAGGSLRLSCAASGRRFSAYGMGWFRQAPGKEREFVAAVSWDGRNTYYADSVKGRFTISADNAKNTVYLQMNSLKPEDTAVYYCASTDDYGVDWGQGTQVTVSS

SEQ ID NO: 189 - protein, 119 aa, Artificial Sequence
  Description of Artificial Sequence: Synthetic polypeptide
EVQLVESGGGLVQAGGSLRLSCAASGSTFDNYAMGWFRQAPGKEREFVSAISGDGGTTYYADSVKGRFTISADNAKNTVYLQMNSLKPEDTAVYYCAAVPRLYRNRDYWGQGTQVTVSS

SEQ ID NO: 190 - protein, 117 aa, Artificial Sequence
  Description of Artificial Sequence: Synthetic polypeptide
EVQLVESGGGLVQAGGSLRLSCAASGSIFRINAMGWFRQAPGKEREGVSWITSFDASTYYADSVRGRFTISADNAKNTVYLQMNSLKPEDTAVYYCAAALDGYSGSWGQGTQVTVSS

SEQ ID NO: 191 - protein, 119 aa, Artificial Sequence
  Description of Artificial Sequence: Synthetic polypeptide
EVQLVESGGGLVQAGGSLRLSCAASGRTFSNYAMGWFRQAPGKEREFVSTISTGGSSTYYADSVKGRFTISADNAKNTVYLQMNSLKPEDTAVYYCAAVPTGRGRRDYWGQGTQVTVSS

SEQ ID NO: 192 - protein, 119 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPVVPNTKDYWGQGTQVTVSS

SEQ ID NO: 193 - protein, 121 aa, Artificial Sequence
  Description of Artificial Sequence: Synthetic polypeptide
EVQLVESGGGLVQAGGSLRLSCAASGNVFMIKDMGWFRQAPGKEREWVTAISWNGGSTDYADSVKGRFTISADNAKNTVYLQMNSLKPEDTAVYYCAAIVTYSDYDLGNDWGQGTQVTVSS

SEQ ID NO: 194 - protein, 119 aa, Artificial Sequence
  Description of Artificial Sequence: Synthetic polypeptide
EVQLVESGGGLVQAGGSLRLSCAASGFPFSIWPMGWFRQAPGKEREFIATIFSGGDTDYADSVKGRFTISADNAKNTVYLQMNSLKPEDTAVYYCAAIAYEEGVYRWDWGQGTQVTVSS

SEQ ID NO: 195 - protein, 118 aa, Artificial Sequence
  Description of Artificial Sequence: Synthetic polypeptide
EVQLVESGGGLVQAGGSLRLSCAASGRGFSRYAMGWFRQAPGKEREFVAAIRWSGKETWYADSVKGRFTISADNAKNTVYLQMNSLKPEDTAVYYCALGPVRRSRLEWGQGTQVTVSS

SEQ ID NO: 196 - protein, 123 aa, Artificial Sequence
  Description of Artificial Sequence: Synthetic polypeptide
EVQLVESGGGLVQAGGSLRLSCAASGRTSDIYGMGWFRQAPGKEREFVARIYWSSGNTYYADSVKGRFTISADNAKNTVYLQMNSLKPEDTAVYYCAAAYRFSDYSRPAGYDWGQGTQVTVSS

SEQ ID NO: 197 - protein, 115 aa, Artificial Sequence
  Description of Artificial Sequence: Synthetic polypeptide
EVQLVESGGGLVQAGGSLRLSCAASGNDFSFNSMGWFRQAPGKEREFLASVSWGFGSTYYADSVKGRFTISADNAKNTVYLQMNSLKPEDTAVYYCARAYGNPTWGQGTQVTVSS

SEQ ID NO: 198 - protein, 117 aa, Artificial Sequence
  Description of Artificial Sequence: Synthetic polypeptide
EVQLVESGGGLVQAGGSLRLSCAASGRTFTDYPMGWFRQAPGKERELESFVPINGTSTYYADSDSGRFTISADNAKNTVYLQMNSLKPEDTAVYYCAAALDGYSCSWGQGTQVTVSS

SEQ ID NO: 199 - protein, 117 aa, Artificial Sequence
  Description of Artificial Sequence: Synthetic polypeptide
EVQLVESGGGLVQAGGSLRLSCAASGRTFSIYAMGWFRQAPGKEREFVATISRGGSTTYYADSVKGRFTISADNAKNTVYLQMNSLKPEDTAVYYCAAGPRSGKDYWGQGTQVTVSS

SEQ ID NO: 200 - protein, 117 aa, Artificial Sequence
  Description of Artificial Sequence: Synthetic polypeptide
EVQLVESGGGLVQAGGSLRLSCAASGFIFQLYVMGWFRQAPGKEREGVTYINNIDGSTYYAYSVRGRFTISADNAKNTVYLQMNSLKPEDTAVYYCAAVRDGYSGSWGQGTQVTVSS

SEQ ID NO: 201 - protein, 118 aa, Artificial Sequence
  Description of Artificial Sequence: Synthetic polypeptide
EVQLVESGGGLVQAGGSLRLSCAASGSTFSSYAMEWFRQAPGKERELVATISRSGGRTYYADSVKGRFTISADNAKNTVYLQMNSLKPEDTAVYYCAAANWYYRYDYWGQGTQVTVSS

SEQ ID NO: 202 - protein, 122 aa, Artificial Sequence
  Description of Artificial Sequence: Synthetic polypeptide
EVQLVESGGGLVQAGGSLRLSCAASGFPFRINAMGWFRQAPGKERELVTAISSSGSSTYYADSVKGRFTISADNAKNTVYLQMNSLKPEDTAVYYCAASGYYATYYGERDYWGQGTQVTVSS

SEQ ID NO: 203 - protein, 118 aa, Artificial Sequence
  Description of Artificial Sequence: Synthetic polypeptide
EVQLVESGGGLVQAGGSLRLSCAASGFTLSSYTMGWFRQAPGKEREFVSAISRGGGNTYYADSVKGRFTISADNAKNTVYLQMNSLKPEDTAVYYCAAVPSYAEYDYWGQGTQVTVSS

SEQ ID NO: 204 - protein, 120 aa, Artificial Sequence
  Description of Artificial Sequence: Synthetic polypeptide
EVQLVESGGGLVQAGGSLRLSCAASGRTFSIYGMGWFRQAPGKEREGVAAINGGGDSTNYADSVKGRFTISADNAKNTVYLQMNSLKPEDTAVYYCAAASASPYSGRNYWGQGTQVTVSS

SEQ ID NO: 205 - protein, 117 aa, Artificial Sequence
  Description of Artificial Sequence: Synthetic polypeptide
EVQLVESGGGLVQAGGSLRLSCAASGLTFSTTVMGWFRQAPGKEREGDGYISITDGSTYYADSVKGRFTISADNAKNTVYLQMNSLKPEDTAVYYCSAALDGYSGSWGQGTQVTVSS

SEQ ID NO: 206 - protein, 120 aa, Artificial Sequence
  Description of Artificial Sequence: Synthetic polypeptide
EVQLVESGGGLVQAGGSLRLSCAASGRTLENYRMGWFRQAPGKEREFVAAVSWSSGNAYYADSVKGRFTISADNAKNTVYLQMNSLKPEDTAVYYCAANWKMLLGVENDWGQGTQVTVSS

SEQ ID NO: 207 - protein, 119 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPTVYGERDYWGQGTQVTVSS

SEQ ID NO: 208 - protein, 119 aa, Artificial Sequence
  Description of Artificial Sequence: Synthetic polypeptide
EVQLVESGGGLVQAGGSLRLSCAASGSILSISPMGWFRQAPGKERELVAINFSWGTTDYADSVKGRFTISADNAKNTVYLQMNSLKPEDTAVYYCAAIAYEQGVYRWDWGQGTQVTVSS

SEQ ID NO: 209 - protein, 122 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAERYRYSGYYARDSWGQGTQVTVSS

SEQ ID NO: 210 - protein, 119 aa, Artificial Sequence
  Description of Artificial Sequence: Synthetic polypeptide
EVQLVESGGGLVQAGGSLRLSCAASGFTLSDYAMGWFRQAPGKEREFVSAISRDGTTTYYADSVKGRFTISADNAKNTVYLQMNSLKPEDTAVYYCAAVPTSQYATDYWGQGTQVTVSS

SEQ ID NO: 211 - protein, 119 aa, Artificial Sequence
  Description of Artificial Sequence: Synthetic polypeptide
EVQLVESGGGLVQAGGSLRLSCAASGRDLDYYVMGWFRQAPGKERELVAIKFSGGTTDYADSVKGRFTISADNAKNTVYLQMNSLKPEDTAVYYCADIAYEEGVYRWDWGQGTQVTVSS

SEQ ID NO: 212 - protein, 117 aa, Artificial Sequence
  Description of Artificial Sequence: Synthetic polypeptide
EVQLVESGGGLVQAGGSLRLSCAASGSIFTFNAMGWFRQAPGKEREFVAGITRSAVSTSYADSVKGRFTISADNAKNTVYLQMNSLKPEDTAVYYCAAFRGIMRPDWGQGTQVTVSS

SEQ ID NO: 213 - protein, 119 aa, Artificial Sequence
  Description of Artificial Sequence: Synthetic polypeptide
EVQLVESGGGLVQAGGSLRLSCAASGRTFDSYAMGWFRQAPGKEREFVAAITSSGGNTYYADSVKGRFTISADNAKNTVYLQMNSLKPEDTAVYYCAAVPARYGARDYWGQGTQVTVSS

SEQ ID NO: 214 - protein, 114 aa, Artificial Sequence
  Description of Artificial Sequence: Synthetic polypeptide
EVQLVESGGGLVQAGGSLRLSCAASGRTFNNDHMGWFRQAPGKEREFVAVIEIGGATNYADSVKGRFTISADNAKNTVYLQMNSLKPEDTAVYYCATWDGRQVWGQGTQVTVSS

SEQ ID NO: 215 - protein, 117 aa, Artificial Sequence
  Description of Artificial Sequence: Synthetic polypeptide
EVQLVESGGGLVQAGGSLRLSCAASGGTFRKLAMGWFRQAPGKERELVAAIRWSGGITWYADSVKGRFTISADNAKNTVYLQMNSLKPEDTAVYYCAATLAKGGGRWGQGTQVTVSS

SEQ ID NO: 216 - protein, 119 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPRAPSDRDYWGQGTQVTVSS

SEQ ID NO: 217 - protein, 122 aa, Artificial Sequence
  Description of Artificial Sequence: Synthetic polypeptide
EVQLVESGGGLVQAGGSLRLSCAASGRTFRIYAMGWFRQAPGKERELVSSISWNSGSTYYADSVKGRFTISADNAKNTVYLQMNSLKPEDTAVYYCAAAAYSYTQGTTYESWGQGTQVTVSS

SEQ ID NO: 218 - protein, 116 aa, Artificial Sequence
  Description of Artificial Sequence: Synthetic polypeptide
EVQLVESGGGLVQAGGSLRLSCAASGRTFTSYRMGWFRQAPGKEREWMGTIDYSGRTYYADSVKGRFTISADNAKNTVYLQMNSLKPEDTAVYYCAAAMDGYSGSWGQGTQVTVSS

SEQ ID NO: 219 - protein, 118 aa, Artificial Sequence
  Description of Artificial Sequence: Synthetic polypeptide
EVQLVESGGGLVQAGGSLRLSCAASGRTFSIYAMGWFRQAPGKEREFVAAINWNGDTTYYADSVKGRFTISADNAKNTVYLQMNSLKPEDTAVYYCAAVPRYSDYDYWGQGTQVTVSS

SEQ ID NO: 220 - protein, 119 aa, Artificial Sequence
  Description of Artificial Sequence: Synthetic polypeptide
EVQLVESGGGLVQAGGSLRLSCAASGRFFSTRVMGWFRQAPGKERELVAIKFSGGTTDYADSVKGRFTISADNAKNTVYLQMNSLKPEDTAVYYCAAIAHEEGVYRWDWGQGTQVTVSS

SEQ ID NO: 221 - protein, 119 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPSVYGTRDYWGQGTQVTVSS

SEQ ID NO: 222 - protein, 117 aa, Artificial Sequence
  Description of Artificial Sequence: Synthetic polypeptide
EVQLVESGGGLVQAGGSLRLSCAASGSTFSIDVMGWFRQAPGKEREGVSYISMSDGRTYYADSVKGRFTISADNAKNTVYLQMNSLKPEDTAVYYCAAELDGYSGSWGQGTQVTVSS

SEQ ID NO: 223 - protein, 121 aa, Artificial Sequence
  Description of Artificial Sequence: Synthetic polypeptide
EVQLVESGGGLVQAGGSLRLSCAASGLSFSGYTMGWFRQAPGKEREVVAAISRTGGSTYYADSVKGRFTISADNAKNTVYLQMNSLKPEDTAVYYCALIQRRAPYSRLETWGQGTQVTVSS

SEQ ID NO: 224 - protein, 121 aa, Artificial Sequence
  Description of Artificial Sequence: Synthetic polypeptide
EVQLVESGGGLVQAGGSLRLSCAASGSTLSIYGMGWFRQAPGKEREGVAAISWSDGSTSYADSVKGRFTISADNAKNTVYLQMNSLKPEDTAVYYCAAVADIGLASDFDYWGQGTQVTVSS

SEQ ID NO: 225 - protein, 119 aa, Artificial Sequence
  Description of Artificial Sequence: Synthetic polypeptide
EVQLVESGGGLVQAGGSLRLSCAASGSTFSNYAMGWFRQAPGKEREFVATITRSSGNTYYADSVKGRFTISADNAKNTVYLQMNSLKPEDTAVYYCAAVPFKPYSYDYWGQGTQVTVSS

SEQ ID NO: 226 - protein, 119 aa, Artificial Sequence
  Description of Artificial Sequence: Synthetic polypeptide
EVQLVESGGGLVQAGGSLRLSCAASGSTFSIYTMGWFRQAPGKEREFVAAISGSSDSTYYADSVKGRFTISADNAKNTVYLQMNSLKPEDTAVYYCATVPKTRYTRDYWGQGTQVTVSS

SEQ ID NO: 227 - protein, 117 aa, Artificial Sequence
  Description of Artificial Sequence: Synthetic polypeptide
EVQLVESGGGLVQAGGSLRLSCAASGNTFSSYAMGWFRQAPGKEREFVAIISRSGGRTYYADSVKGRFTISADNAKNTVYLQMNSLKPEDTAVYYCAAAPYNETNSWGQGTQVTVSS

SEQ ID NO: 228 - protein, 117 aa, Artificial Sequence
  Description of Artificial Sequence: Synthetic polypeptide
EVQLVESGGGLVQAGGSLRLSCAASGSTFSTYAMGWFRQAPGKEREFVASISRSGGRTYYADSVKGRFTISADNAKNTVYLQMNSLKPEDTAVYYCAAARYNERNSWGQGTQVTVSS

SEQ ID NO: 229 - protein, 119 aa, Artificial Sequence
  Description of Artificial Sequence: Synthetic polypeptide
EVQLVESGGGLVQAGGSLRLSCAASGGTLNNNPMAMGWFRQAPGKEREFVVAIYWSNGKTPYADSVKRRFTISADNAKNTVYLQMNSLKPEDTAVYYCAAALDGYSGAWGQGTQVTVSS

SEQ ID NO: 230 - protein, 119 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPRAPSERDYWGQGTQVTVSS

SEQ ID NO: 231 - protein, 114 aa, Artificial Sequence
  Description of Artificial Sequence: Synthetic polypeptide
EVQLVESGGGLVQAGGSLRLSCAASGRTFNNNDMGWFRQAPGKEREFVAVIKLGGATTYDDYSEGRFTISADNAKNTVYLQMNSLKPEDTAVYYCATWDARHVWGQGTQVTVSS

SEQ ID NO: 232 - protein, 117 aa, Artificial Sequence
  Description of Artificial Sequence: Synthetic polypeptide
EVQLVESGGGLVQAGGSLRLSCAASGRAFSYYNMGWFRQAPGKEREGVSWISSSDGSTYYADSVKGRFTISADNAKNTVYLQMNSLKPEDTAVYYCAAVLDGCSGSWGQGTQVTVSS

SEQ ID NO: 233 - protein, 122 aa, Artificial Sequence
  Description of Artificial Sequence: Synthetic polypeptide
EVQLVESGGGLVQAGGSLRLSCAASGSTFSTYAMGWFRQAPGKEREFVAAINRSGASTYYADSVKGRFTISADNAKNTVYLQMNSLKPEDTAVYYCAAALLGGRGGCGKGYWGQGTQVTVSS

SEQ ID NO: 234 - protein, 116 aa, Artificial Sequence
  Description of Artificial Sequence: Synthetic polypeptide
EVQLVESGGGLVQAGGSLRLSCAASGSILDTYAMGWFRQAPGKERELVSGINTSGDTTYYADSVKGRFTISADNAKNTVYLQMNSLKPEDTAVYYCAAVLAGYEYWGQGTQVTVSS

SEQ ID NO: 235 - protein, 113 aa, Artificial Sequence
  Description of Artificial Sequence: Synthetic polypeptide
EVQLVESGGGLVQAGGSLRLSCAASGSTLSINAMGWFRQAPGKEREFVAHMSHDGTTNYADSVKGRFTISADNAKNTVYLQMNSLKPEDTAVYYCARLPNYRWGQGTQVTVSS

SEQ ID NO: 236 - protein, 118 aa, Artificial Sequence
  Description of Artificial Sequence: Synthetic polypeptide
EVQLVESGGGLVQAGGSLRLSCAASGSIFRLNAMGWFRQAPGKEREGVAAINNFDTTKYADSSKGRFTISADNAKNTVYLQMNSLKPEDTAVYYCAAVRWGPRSDDRWGQGTQVTVSS

SEQ ID NO: 237 - protein, 127 aa, Artificial Sequence
  Description of Artificial Sequence: Synthetic polypeptide
EVQLVESGGGLVQAGGSLRLSCAASGLTNPPFDNFPMGWFRQAPGKEREFVAVISWTGGSTYYADSVKGRFTISADNAKNTVYLQMNSLKPEDTAVYYCPAVYPRYYGDDDRPPVDWGQGTQVTVSS

SEQ ID NO: 238 - protein, 117 aa, Artificial Sequence
  Description of Artificial Sequence: Synthetic polypeptide
EVQLVESGGGLVQAGGSLRLSCAASGPTFSKAVMGWFRQAPGKEREFVAAMNWSGRSTYYADSVKGRFTISADNAKNTVYLQMNSLKPEDTAVYYCAATPAGRGGYWGQGTQVTVSS

SEQ ID NO: 239 - protein, 119 aa, Artificial Sequence
  Description of Artificial Sequence: Synthetic polypeptide
EVQLVESGGGLVQAGGSLRLSCAASGSIFSDYAMGWFRQAPGKEREFVATINWGGGRTYYADSVKGRFTISADNAKNTVYLQMNSLKPEDTAVYYCAAVPKTRYARDYWGQGTQVTVSS

SEQ ID NO: 240 - protein, 118 aa, Artificial Sequence
  Description of Artificial Sequence: Synthetic polypeptide
EVQLVESGGGLVQAGGSLRLSCAASGFILSDYAMGWFRQAPGKEREFVAAISSSEASTYYADSVKGRFTISADNAKNTVYLQMNSLKPEDTAVYYCAAVRFWAGYDSWGQGTQVTVSS

SEQ ID NO: 241 - protein, 123 aa, Artificial Sequence
  Description of Artificial Sequence: Synthetic polypeptide
EVQLVESGGGLVQAGGSLRLSCAASGYTDYKYDMGWFRQAPGKEREFVAAISWGGGLTVYADSVKGRFTISADNAKNTVYLQMNSLKPEDTAVYYCAAVATVTDYTGTYSDGWGQGTQVTVSS

SEQ ID NO: 242 - protein, 119 aa, Artificial Sequence
  Description of Artificial Sequence: Synthetic polypeptide
EVQLVESGGGLVQAGGSLRLSCAASGRTFSNYAMGWFRQAPGKEREFVATINWGGGNTYYADSVKGRFTISADNAKNTVYLQMNSLKPEDTAVYYCAAVPKTRYAYDYWGQGTQVTVSS

SEQ ID NO: 243 - protein, 122 aa, Artificial Sequence
  Description of Artificial Sequence: Synthetic polypeptide
EVQLVESGGGLVQAGGSLRLSCAASGRTFSRYYMGWFRQAPGKERELVAVILRGGSTNYADSVKGRFTISADNAKNTVYLQMNSLKPEDTAVYYCAAARRYGNLYNTNNYDWGQGTQVTVSS

SEQ ID NO: 244 - protein, 119 aa, Artificial Sequence
  Description of Artificial Sequence: Synthetic polypeptide
EVQLVESGGGLVQAGGSLRLSCAASGSILSSYVMGWFRQAPGKEREFVSAISRSGTSTYYADSVKGRFTISADNAKNTVYLQMNSLKPEDTAVYYCAAVPKTRYDRDYWGQGTQVTVSS

SEQ ID NO: 245 - protein, 119 aa, Artificial Sequence
  Description of Artificial Sequence: Synthetic polypeptide
EVQLVESGGGLVQAGGSLRLSCAASGFTLDNYAMGWFRQAPGKEREFVAAISWSGGSTYYADSVKGRFTISADNAKNTVYLQMNSLKPEDTAVYYCAAVPKTRYSYDYWGQGTQVTVSS

SEQ ID NO: 246 - protein, 122 aa, Artificial Sequence
  Description of Artificial Sequence: Synthetic polypeptide
EVQLVESGGGLVQAGGSLRLSCAASGNTYSYKVMGWFRQAPGKEREFVGIIIRNGDTTYYADSVKGRFTISADNAKNTVYLQMNSLKPEDTAVYYCAASPKYMTAYERSYDWGQGTQVTVSS

SEQ ID NO: 247 - protein, 119 aa, Artificial Sequence
  Description of Artificial Sequence: Synthetic polypeptide
EVQLVESGGGLVQAGGSLRLSCAASGSIFRNYAMGWFRQAPGKEREFVATITTSGGNTYYADSVKGRFTISADNAKNTVYLQMNSLKPEDTAVYYCAAVPKTRYRRDYWGQGTQVTVSS

SEQ ID NO: 248 - protein, 123 aa, Artificial Sequence
  Description of Artificial Sequence: Synthetic polypeptide
EVQLVESGGGLVQAGGSLRLSCAASGFTFGTTTMGWFRQAPGKEREVVAAITGSGRSTYYADSVKGRFTISADNAKNTVYLQMNSLKPEDTAVYYCAASAIGSGALRRFEYDWGQGTQVTVSS

SEQ ID NO: 249 - protein, 125 aa, Artificial Sequence
  Description of Artificial Sequence: Synthetic polypeptide
EVQLVESGGGLVQAGGSLRLSCAASGGTFSAYAMGWFRQAPGKEREGVAAIRWDGGYTRYADSVKGRFTISADNAKNTVYLQMNSLKPEDTAVYYCAATTPTTSYLPRSERQYEWGQGTQVTVSS

SEQ ID NO: 250 - protein, 119 aa, Artificial Sequence
  Description of Artificial Sequence: Synthetic polypeptide
EVQLVESGGGLVQAGGSLRLSCAASGRTFSSYAMGWFRQAPGKEREFVAAISWSGGSTYYADSVKGRFTISADNAKNTVYLQMNSLKPEDTAVYYCAAVPSVYGERDYWGQGTQVTVSS

SEQ ID NO: 251 - protein, 123 aa, Artificial Sequence
  Description of Artificial Sequence: Synthetic polypeptide
EVQLVESGGGLVQAGGSLRLSCAASGSFFSINAMGWFRQAPGKEREFVAGISQSGGSTAYADSVKGRFTISADNAKNTVYLQMNSLKPEDTAVYYCAAHRIVVGGTSVGDWRWGQGTQVTVSS

SEQ ID NO: 252 - protein, 113 aa, Artificial Sequence
  Description of Artificial Sequence: Synthetic polypeptide
EVQLVESGGGLVQAGGSLRLSCAASGRTFSSYRMGWFRQAPGKEREMVASITSRKIPKYADSVKGRFTISADNAKNTVYLQMNSLKPEDTAVYYCAVWSGRDWGQGTQVTVSS

SEQ ID NO: 253 - protein, 123 aa, Artificial Sequence
  Description of Artificial Sequence: Synthetic polypeptide
EVQLVESGGGLVQAGGSLRLSCAASGFTFRRYVMGWFRQAPGKEREFVAAISRDGDRTYYADSVKGRFTISADNAKNTVYLQMNSLKPEDTAVYYCASTRLAGRWYRDSEYKWGQGTQVTVSS

SEQ ID NO: 254 - protein, 117 aa, Artificial Sequence
  Description of Artificial Sequence: Synthetic polypeptide
EVQLVESGGGLVQAGGSLRLSCAASGRTFSDNAMGWFRQAPGKEREFVATISRGGSRTSYADSVKGRFTISADNAKNTVYLQMNSLKPEDTAVYYCAAGPRSGRDYWGQGTQVTVSS

SEQ ID NO: 255 - protein, 116 aa, Artificial Sequence
  Description of Artificial Sequence: Synthetic polypeptide
EVQLVESGGGLVQAGGSLRLSCAASGFTFRSYAMGWFRQAPGKEREFVATITRNGDNTYYADSVKGRFTISADNAKNTVYLQMNSLKPEDTAVYYCATVGTRYNYWGQGTQVTVSS

SEQ ID NO: 256 - protein, 117 aa, Artificial Sequence
  Description of Artificial Sequence: Synthetic polypeptide
EVQLVESGGGLVQAGGSLRLSCAASGSTFSDYVMGWFRQAPGKERELISGITWNGDTTYYADSVKGRFTISADNAKNTVYLQMNSLKPEDTAVYYCAVVRLGGYDYWGQGTQVTVSS

SEQ ID NO: 257 - protein, 114 aa, Artificial Sequence
  Description of Artificial Sequence: Synthetic polypeptide
EVQLVESGGGLVQAGGSLRLSCAASGGIISNYHMGWFRQAPGKEREFVATITRSGGSTYYADSVKGRFTISADNAKNTVYLQMNSLKPEDTAVYYCAMAGRGRWGQGTQVTVSS

SEQ ID NO: 258 - protein, 127 aa, Artificial Sequence
  Description of Artificial Sequence: Synthetic polypeptide
EVQLVESGGGLVQAGGSLRLSCAASGFSFDDDYVMGWFRQAPGKERELVSAIGWSGASTYYADSVKGRFTISADNAKNTVYLQMNSLKPEDTAVYYCAAYYTDYDEALEETRGSYDWGQGTQVTVSS

SEQ ID NO: 259 - protein, 123 aa, Artificial Sequence
  Description of Artificial Sequence: Synthetic polypeptide
EVQLVESGGGLVQAGGSLRLSCAASGSTFPIYAMGWFRQAPGKEREWVSGISSRDDTTYYADSVKGRFTISADNAKNTVYLQMNSLKPEDTAVYYCSAHRIVFRGTSVGDWRWGQGTQVTVSS

SEQ ID NO: 260 - protein, 117 aa, Artificial Sequence
  Description of Artificial Sequence: Synthetic polypeptide
EVQLVESGGGLVQAGGSLRLSCAASGRAFSYYNMGWFRQAPGKEREGVSWISSSDGSTYYADSVKGRFTISADNAKNTVYLQMNSLKPEDTAVYYCAAVLDGYSGSWGQGTQVTVSS

SEQ ID NO: 261 - protein, 122 aa, Artificial Sequence
  Description of Artificial Sequence: Synthetic polypeptide
EVQLVESGGGLVQAGGSLRLSCAASGSTFSIDVMGWFRQAPGKERELVAATGRRGGPTYYADSVKGRFTISADNAKNTVYLQMNSLKPEDTAVYYCAARTSYSGTYDYGVDWGQGTQVTVSS

SEQ ID NO: 262 - protein, 116 aa, Artificial Sequence
  Description of Artificial Sequence: Synthetic polypeptide
EVQLVESGGGLVQAGGSLRLSCAASGGTFSSYAMGWFRQAPGKEREFVAAINWSGSITYYADSVKGRFTISADNAKNTVYLQMNSLKPEDTAVYYCAVGRSGRDYWGQGTQVTVSS

SEQ ID NO: 263 - protein, 120 aa, Artificial Sequence
  Description of Artificial Sequence: Synthetic polypeptide
EVQLVESGGGLVQAGGSLRLSCAASGSIFRINAMGWFRQAPGKEREGVAAINNFGTTKYADSVKGRFTISADNAKNTVYLQMNSLKPEDTAVYYCAAVRWGPRNDDRYDWGQGTQVTVSS

SEQ ID NO: 264 - protein, 119 aa, Artificial Sequence
  Description of Artificial Sequence: Synthetic polypeptide
EVQLVESGGGLVQAGGSLRLSCAASGGTLNNNPMAMGWFRQAPGKEREFVVAIYWSNGKTQYADSVKGRFTISADNAKNTVYLQMNSLKPEDTAVYYCAAALDGYSGSWGQGTQVTVSS

SEQ ID NO: 265 - protein, 114 aa, Artificial Sequence
  Description of Artificial Sequence: Synthetic polypeptide
EVQLVESGGGLVQAGGSLRLSCAASGRTFNNDHMGWFRQAPGKEREFVAVIEIGGATNYADSVKGRFTISADNAKNTVYLQMNSLKPEDTAVYYCASWDGRQVWGQGTQVTVSS

SEQ ID NO: 266 - protein, 119 aa, Artificial Sequence
  Description of Artificial Sequence: Synthetic polypeptide
EVQLVESGGGLVQPGGSLRLSCAASGRTFAMGWMGWFRQAPGKEREFVARVSWDGRNAYYANSRFGRFTISADNSKNTAYLQMNSLKPEDTAVYYCPRYVSPARDHGCWGQGTLVTVSS

SEQ ID NO: 267 - protein, 126 aa, Artificial Sequence
  Description of Artificial Sequence: Synthetic polypeptide
EVQLVESGGGLVQPGGSLRLSCAASGLTISTYIMGWFRQAPGKEREFVAVVNWNGDSTYYADSVKGRFTISADNSKNTAYLQMNSLKPEDTAVYYCAAYYTDYDEALEETRGSYDWGQGTLVTVSS

SEQ ID NO: 268 - protein, 121 aa, Artificial Sequence
  Description of Artificial Sequence: Synthetic polypeptide
EVQLVESGGGLVQPGGSLRLSCAASGTLFKINAMGWFRQAPGKERELVAAINRGGKITHYADSVKGRFTISADNSKNTAYLQMNSLKPEDTAVYYCAASLRNSGSNVEGRWGQGTLVTVSS

SEQ ID NO: 269 - protein, 125 aa, Artificial Sequence
  Description of Artificial Sequence: Synthetic polypeptide
EVQLVESGGGLVQPGGSLRLSCAASGVTLDLYAMGWFRQAPGKEREFVAAISPSAVTTYYADSVKGRFTISADNSKNTAYLQMNSLKPEDTAVYYCAAYDYYSDYPLPDANEYEWGQGTLVTVSS

SEQ ID NO: 270 - protein, 127 aa, Artificial Sequence
  Description of Artificial Sequence: Synthetic polypeptide
EVQLVESGGGLVQPGGSLRLSCAASGRTFSDYIMGWFRQAPGKEREFVAVINRSGSTTYYADSVKGRFTISADNSKNTAYLQMNSLKPEDTAVYYCAAVQAYSNSSDYYSQEGAYDWGQGTLVTVSS

SEQ ID NO: 271 - protein, 117 aa, Artificial Sequence
  Description of Artificial Sequence: Synthetic polypeptide
EVQLVESGGGLVQPGGSLRLSCAASGFTFSNYVMGWFRQAPGKEREGVSYISSSDGRTHYADSVKGRFTISADNSKNTAYLQMNSLKPEDTAVYYCAAVLDGYNGSWGQGTLVTVSS

SEQ ID NO: 272 - protein, 123 aa, Artificial Sequence
  Description of Artificial Sequence: Synthetic polypeptide
EVQLVESGGGLVQPGGSLRLSCAASGFTFSRFGMGWFRQAPGKEREGVAAIGSDGSTSYADSVKGRFTISADNSKNTAYLQMNSLKPEDTAVYYCASGRDRYARDLSEYEYVWGQGTLVTVSS

SEQ ID NO: 273 - protein, 120 aa, Artificial Sequence
  Description of Artificial Sequence: Synthetic polypeptide
EVQLVESGGGLVQPGGSLRLSCAASGFTFRFNAMGWFRQAPGKEREFVAAINWRGSHPYYADSVKGRFTISADNSKNTAYLQMNSLKPEDTAVYYCAAATLGEPLVKYTWGQGTLVTVSS

SEQ ID NO: 274 - protein, 126 aa, Artificial Sequence
  Description of Artificial Sequence: Synthetic polypeptide
EVQLVESGGGLVQPGGSLRLSCAASGGTFGVYHMGWFRQAPGKEREFLASVTWGFGSTYYADSVKGRFTISADNSKNTAYLQMNSLKPEDTAVYYCAATTTRSYDDTYRNSWVYNWGQGTLVTVSS

SEQ ID NO: 275 - protein, 120 aa, Artificial Sequence
  Description of Artificial Sequence: Synthetic polypeptide
EVQLVESGGGLVQPGGSLRLSCAASGFSFDDYAMGWFRQAPGKERELVAAIRWSGGITWYADSVKGRFTISADNSKNTAYLQMNSLKPEDTAVYYCAAYGSGSDYLPMDWGQGTLVTVSS

SEQ ID NO: 276 - protein, 127 aa, Artificial Sequence
  Description of Artificial Sequence: Synthetic polypeptide
EVQLVESGGGLVQPGGSLRLSCAASGPTFTIYAMGWFRQAPGKEREFVGAISMSGEDTIYADSEKGRFTISADNSKNTAYLQMNSLKPEDTAVYYCAAVQAYTSNTNYYNQEGAYDWGQGTLVTVSS

SEQ ID NO: 277 - protein, 117 aa, Artificial Sequence
  Description of Artificial Sequence: Synthetic polypeptide
EVQLVESGGGLVQPGGSLRLSCAASGPTFSNYYVGWFRQAPGKEREFVAAILCSGGITCYADSVKGRFTISADNSKNTAYLQMNSLKPEDTAVYYCAAALDGYIGTWGQGTLVTVSS

SEQ ID NO: 278 - protein, 123 aa, Artificial Sequence
  Description of Artificial Sequence: Synthetic polypeptide
EVQLVESGGGLVQPGGSLRLSCAASGGTFSSIGMGWFRQAPGKEREGVAAIGSDGSTSYADSVKGRFTISADNSKNTAYLQMNSLKPEDTAVYYCAAASDRYARVLTEYEYVWGQGTLVTVSS

SEQ ID NO: 279 - protein, 116 aa, Artificial Sequence
  Description of Artificial Sequence: Synthetic polypeptide
EVQLVESGGGLVQPGGSLRLSCAASGVTFNNYGMGWFRQAPGKERELVAAIRWSGSATFYADSVKGRFTISADNSKNTAYLQMNSLKPEDTAVYYCAADDGARGSWGQGTLVTVSS

SEQ ID NO: 280 - protein, 120 aa, Artificial Sequence
  Description of Artificial Sequence: Synthetic polypeptide
EVQLVESGGGLVQPGGSLRLSCAASGRTFTMDGMGWFRQAPGKEREGVAAIGSDGSTSYADSVKGRFTISADNSKNTAYLQMNSLKPEDTAVYYCAAGSNIGGSRWRYDWGQGTLVTVSS

SEQ ID NO: 281 - protein, 126 aa, Artificial Sequence
  Description of Artificial Sequence: Synthetic polypeptide
EVQLVESGGGLVQPGGSLRLSCAASGGIFRFNAMGWFRQAPGKERELVAAISPAALTTYYADSVKGRFTISADNSKNTAYLQMNSLKPEDTAVYYCAAYLPSPYYSSYYDSTKYEWGQGTLVTVSS

SEQ ID NO: 282 - protein, 123 aa, Artificial Sequence
  Description of Artificial Sequence: Synthetic polypeptide
EVQLVESGGGLVQPGGSLRLSCAASGSGFSPNVMGWFRQAPGKEREVVAAISWNGGSTYYADSVKGRFTISADNSKNTAYLQMNSLKPEDTAVYYCAASAIGSGALRRFEYDWGQGTLVTVSS

SEQ ID NO: 283 - protein, 125 aa, Artificial Sequence
  Description of Artificial Sequence: Synthetic polypeptide
EVQLVESGGGLVQPGGSLRLSCAASGFTFGFYAMGWFRQAPGKERELVAAISWSDASTYYADSVKGRFTISADNSKNTAYLQMNSLKPEDTAVYYCALDNRRSYVDYYNVSEYDWGQGTLVTVSS

SEQ ID NO: 284 - protein, 116 aa, Artificial Sequence
  Description of Artificial Sequence: Synthetic polypeptide
EVQLVESGGGLVQPGGSLRLSCAASGFTFSIYPMGWFRQAPGKERECVSTIWSRGDTYYADNVKGRFTISADNSKNTAYLQMNSLKPEDTAVYYCAAALDGYSATWGQGTLVTVSS

SEQ ID NO: 285 - protein, 125 aa, Artificial Sequence
  Description of Artificial Sequence: Synthetic polypeptide
EVQLVESGGGLVQPGGSLRLSCAASGFTFDYYAMGWFRQAPGKERELVAAISWSNDITYYADSVKGRFTISADNSKNTAYLQMNSLKPEDTAVYYCALDNRRSYVDYYSVSEYDWGQGTLVTVSS

SEQ ID NO: 286 - protein, 117 aa, Artificial Sequence
  Description of Artificial Sequence: Synthetic polypeptide
EVQLVESGGGLVQPGGSLRLSCAASGGTFSTYTMGWFRQAPGKEREFVAGIYNDGTASYYADSVKGRFTISADNSKNTAYLQMNSLKPEDTAVYYCAAFDGYTGNDWGQGTLVTVSS

SEQ ID NO: 287 - protein, 117 aa, Artificial Sequence
  Description of Artificial Sequence: Synthetic polypeptide
EVQLVESGGGLVQPGGSLRLSCAASGVTLDLYAMGWFRQAPGKEREWVARMYLDGDYPYYADSVKGRFTISADNSKNTAYLQMNSLKPEDTAVYYCAAVLDGYSGSWGQGTLVTVSS

SEQ ID NO: 288 - protein, 123 aa, Artificial Sequence
  Description of Artificial Sequence: Synthetic polypeptide
EVQLVESGGGLVQPGGSLRLSCAASGRTISRYIMGWFRQAPGKERELVAAINRSGKSTYYADSVKGRFTISADNSKNTAYLQMNSLKPEDTAVYYCASTRFAGRWYRDSEYKWGQGTLVTVSS

SEQ ID NO: 289 - protein, 117 aa, Artificial Sequence
  Description of Artificial Sequence: Synthetic polypeptide
EVQLVESGGGLVQPGGSLRLSCAASGRTLSVYAMGWFRQAPGKEREFVAAVRWSGGITWYVDSVKGRFTISADNSKNTAYLQMNSLKPEDTAVYYCAAFDGYSGSDWGQGTLVTVSS

SEQ ID NO: 290 - protein, 130 aa, Artificial Sequence
  Description of Artificial Sequence: Synthetic polypeptide
EVQLVESGGGLVQPGGSLRLSCAASGSIFSITEMGWFRQAPGKERELVAAIAVGGGITWYADSVKGRFTISADNSKNTAYLQMNSLKPEDTAVYYCAAHDVDDDESPYYSGGYYRALYDWGQGTLVTVSS

SEQ ID NO: 291 - protein, 129 aa, Artificial Sequence
  Description of Artificial Sequence: Synthetic polypeptide
EVQLVESGGGLVQPGGSLRLSCAASGSIYSLDAMGWFRQAPGKERELVAAISPAALTTYYADSVKGRFTISADNSKNTAYLQMNSLKPEDTAVYYCAASMSLRPLDPASYSPDIQPYDWGQGTLVTVSS

SEQ ID NO: 292 - protein, 116 aa, Artificial Sequence
  Description of Artificial Sequence: Synthetic polypeptide
EVQLVESGGGLVQPGGSLRLSCAASGFTCGDYTMGWFRQAPGKERESVAAIDSDGRTHYADSVISRFTISADNSKNTAYLQMNSLKPEDTAVYYCAAALDGYSGDWGQGTLVTVSS

SEQ ID NO: 293 - protein, 124 aa, Artificial Sequence
  Description of Artificial Sequence: Synthetic polypeptide
EVQLVESGGGLVQPGGSLRLSCAASGRTLSFYAMGWFRQAPGKEREFVAAINRGGRISHYADSVKGRFTISADNSKNTAYLQMNSLKPEDTAVYYCAAGRRYGSPPHDGSSYEWGQGTLVTVSS

SEQ ID NO: 294 - protein, 114 aa, Artificial Sequence
  Description of Artificial Sequence: Synthetic polypeptide
EVQLVESGGGLVQPGGSLRLSCAASGFTFDDYAMGWFRQAPGKEREFVAGISWTGGITYYADSVKGRFTISADNSKNTAYLQMNSLKPEDTAVYYCAVNVGFEWGQGTLVTVSS

SEQ ID NO: 295 - protein, 121 aa, Artificial Sequence
  Description of Artificial Sequence: Synthetic polypeptide
EVQLVESGGGLVQPGGSLRLSCAASGFTFDDYGMGWFRQAPGKEREGVAAIGSDGSTSYADSVKGRFTISADNSKNTAYLQMNSLKPEDTAVYYCAATLRATITNFDEYVWGQGTLVTVSS

SEQ ID NO: 296 - protein, 122 aa, Artificial Sequence
  Description of Artificial Sequence: Synthetic polypeptide
EVQLVESGGGLVQPGGSLRLSCAASGRTFNRYPMGWFRQAPGKEREFVAHMSHDGTTNYADSVKGRFTISADNSKNTAYLQMNSLKPEDTAVYYCAAPGTRYYGSNQVNYNWGQGTLVTVSS

SEQ ID NO: 297 - protein, 117 aa, Artificial Sequence
  Description of Artificial Sequence: Synthetic polypeptide
EVQLVESGGGLVQPGGSLRLSCAASGSIFSFNAMGWFRQAPGKEREFVAGITRRGLSTSYADSVKGRFTISADNSKNTAYLQMNSLKPEDTAVYYCAAAKGIGVYGWGQGTLVTVSS

SEQ ID NO: 298 - protein, 125 aa, Artificial Sequence
  Description of Artificial Sequence: Synthetic polypeptide
EVQLVESGGGLVQPGGSLRLSCAASGGSISSINAMGWFRQAPGKERELVAGIITSGDSTYYADSVKGRFTISADNSKNTAYLQMNSLKPEDTAVYYCAAGSAYVAGVRRRNAYHWGQGTLVTVSS

SEQ ID NO: 299 - protein, 125 aa, Artificial Sequence
  Description of Artificial Sequence: Synthetic polypeptide
EVQLVESGGGLVQPGGSLRLSCAASGGTFSADVMGWFRQAPGKEREFVAAISTGSITIYADSVKGRFTISADNSKNTAYLQMNSLKPEDTAVYYCATYGYDSGLYFITDSNDYEWGQGTLVTVSS

SEQ ID NO: 300 - protein, 125 aa, Artificial Sequence
  Description of Artificial Sequence: Synthetic polypeptide
EVQLVESGGGLVQPGGSLRLSCAASGFTFDDAAMGWFRQAPGKEREFVAAMRWRGGITWYADSVKGRFTISADNSKNTAYLQMNSLKPEDTAVYYCAAQGTLYDDYDGLPIKYDWGQGTLVTVSS

SEQ ID NO: 301 - protein, 123 aa, Artificial Sequence
  Description of Artificial Sequence: Synthetic polypeptide
EVQLVESGGGLVQPGGSLRLSCAASGDIFNINAMGWFRQAPGKEREPVAAISPAALTTYYADSVKGRFTISADNSKNTAYLQMNSLKPEDTAVYYCAATPIERLGLDAYEYDWGQGTLVTVSS

SEQ ID NO: 302 - protein, 126 aa, Artificial Sequence
  Description of Artificial Sequence: Synthetic polypeptide
EVQLVESGGGLVQPGGSLRLSCAASGRTFSTYNMGWFRQAPGKEREFVAAINWSGGITWYADSVKGRFTISADNSKNTAYLQMNSLKPEDTAVYYCAAEPPDSSWYLDGSPEFFKWGQGTLVTVSS

SEQ ID NO: 303 - protein, 125 aa, Artificial Sequence
  Description of Artificial Sequence: Synthetic polypeptide
EVQLVESGGGLVQPGGSLRLSCAASGSISVFDAMGWFRQAPGKERELVAGISGSGGDTYYADSVKGRFTISADNSKNTAYLQMNSLKPEDTAVYYCAASPKYSTHSIFDASPYNWGQGTLVTVSS

SEQ ID NO: 304 - protein, 126 aa, Artificial Sequence
  Description of Artificial Sequence: Synthetic polypeptide
EVQLVESGGGLVQPGGSLRLSCAASGFTSDDYAMGWFRQAPGKEREFVAALRWSSSNIDYTYYADSVKGRFTISADNSKNTAYLQMNSLKPEDTAVYYCATDLSGHGDVSEYEYDWGQGTLVTVSS

SEQ ID NO: 305 - protein, 123 aa, Artificial Sequence
  Description of Artificial Sequence: Synthetic polypeptide
EVQLVESGGGLVQPGGSLRLSCAASGFTFSPNVMGWFRQAPGKEREFVAAITSSGETTWYADSVKGRFTISADNSKNTAYLQMNSLKPEDTAVYYCAAEPYGSGSSLMSEYDWGQGTLVTVSS

SEQ ID NO: 306 - protein, 120 aa, Artificial Sequence
  Description of Artificial Sequence: Synthetic polypeptide
EVQLVESGGGLVQPGGSLRLSCAASGRNLRMYRMGWFRQAPGKEREFVAAINWSGDNTHYADSVKGRFTISADNSKNTAYLQMNSLKPEDTAVYYCAANWKMLLGVENDWGQGTLVTVSS

SEQ ID NO: 307 - protein, 126 aa, Artificial Sequence
  Description of Artificial Sequence: Synthetic polypeptide
EVQLVESGGGLVQPGGSLRLSCAASGDTFNCYAMGWFRQAPGKEREFVAVINWSGDNTHYADSVKGRFTISADNSKNTAYLQMNSLKPEDTAVYYCAAYYTDYDEALEETRGRYDWGQGTLVTVSS

SEQ ID NO: 308 - protein, 123 aa, Artificial Sequence
  Description of Artificial Sequence: Synthetic polypeptide
EVQLVESGGGLVQPGGSLRLSCAASGSISTINVMGWFRQAPGKEREFVAAISPSAVTTYYADSVKGRFTISADNSKNTAYLQMNSLKPEDTAVYYCATDLSGRGDVSEYEYDWGQGTLVTVSS

SEQ ID NO: 309 - protein, 118 aa, Artificial Sequence
  Description of Artificial Sequence: Synthetic polypeptide
EVQLVESGGGLVQPGGSLRLSCAASGRTLSKYRMGWFRQAPGKEREFVAAIRWSGGITWYADSVKGRFTISADNSKNTAYLQMNSLKPEDTAVYYCAIPHGIAGRITWGQGTLVTVSS

SEQ ID NO: 310 - protein, 124 aa, Artificial Sequence
  Description of Artificial Sequence: Synthetic polypeptide
EVQLVESGGGLVQPGGSLRLSCAASGFTFGSYAMGWFRQAPGKERELVAGIDQSGGITWYADSVKGRFTISADNSKNTAYLQMNSLKPEDTAVYYCAADDYLGGDNWYLGPYDWGQGTLVTVSS

SEQ ID NO: 311 - protein, 126 aa, Artificial Sequence
  Description of Artificial Sequence: Synthetic polypeptide
EVQLVESGGGLVQPGGSLRLSCAASGFTIDDYAMGWFRQAPGKEREFVAAVSGTGTIAYYADSVKGRFTISADNSKNTAYLQMNSLKPEDTAVYYCAAYYIDYDEALEETRGSYDWGQGTLVTVSS

SEQ ID NO: 312 - protein, 120 aa, Artificial Sequence
  Description of Artificial Sequence: Synthetic polypeptide
EVQLVESGGGLVQPGGSLRLSCAASGRTFNNYVMGWFRQAPGKERELVAGITSGRDITYYADSVKGRFTISADNSKNTAYLQMNSLKPEDTAVYYCAADGVLATTLNWDWGQGTLVTVSS

SEQ ID NO: 313 - protein, 120 aa, Artificial Sequence
  Description of Artificial Sequence: Synthetic polypeptide
EVQLVESGGGLVQPGGSLRLSCAASGSGISFNAMGWFRQAPGKERELVAAISRSGDTTYYADSVKGRFTISADNSKNTAYLQMNSLKPEDTAVYYCAADLTTWADGPYRWGQGTLVTVSS

SEQ ID NO: 314 - protein, 124 aa, Artificial Sequence
  Description of Artificial Sequence: Synthetic polypeptide
EVQLVESGGGLVQPGGSLRLSCAASGRTFSFYAMGWFRQAPGKEREFVAAINRGGKISHYADSVKGRFTISADNSKNTAYLQMNSLKPEDTAVYYCAAVRRYGNPPHDGSSYEWGQGTLVTVSS

SEQ ID NO: 315 - protein, 117 aa, Artificial Sequence
  Description of Artificial Sequence: Synthetic polypeptide
EVQLVESGGGLVQPGGSLRLSCAASGRTFSFYGMGWFRQAPGKERELVAIKFSGGTTDYADSVKGRFTISADNSKNTAYLQMNSLKPEDTAVYYCAAIAHEEGVYRWGQGTLVTVSS

SEQ ID NO: 316 - protein, 117 aa, Artificial Sequence
  Description of Artificial Sequence: Synthetic polypeptide
EVQLVESGGGLVQPGGSLRLSCAASGGIFRFNAMGWFRQAPGKERELVAGISGSGGDTYYADSVKGRFTISADNSKNTAYLQMNSLKPEDTAVYYCAAFRGIMRPDWGQGTLVTVSS

SEQ ID NO: 317 - protein, 124 aa, Artificial Sequence
  Description of Artificial Sequence: Synthetic polypeptide
EVQLVESGGGLVQPGGSLRLSCAASGRTFSFYAMGWFRQAPGKEREFVAAINRGGKISHYADSVKGRFTISADNSKNTAYLQMNSLKPEDTAVYYCAAVRRYGSPPHDGSSYEWGQGTLVTVSS

SEQ ID NO: 318 - protein, 116 aa, Artificial Sequence
  Description of Artificial Sequence: Synthetic polypeptide
EVQLVESGGGLVQPGGSLRLSCAASGSDFSLNAMGWFRQAPGKEREFVAAISWSGGSTLYADSVKGRFTISADNSKNTAYLQMNSLKPEDTAVYYCASNESDAYNWGQGTLVTVSS

SEQ ID NO: 319 - protein, 117 aa, Artificial Sequence
  Description of Artificial Sequence: Synthetic polypeptide
EVQLVESGGGLVQPGGSLRLSCAASGRTLVNYDMGWFRQAPGKEREFVAAIRWSGGITWYADSVKGRFTISADNSKNTAYLQMNSLKPEDTAVYYCAAFRGIMLPPWGQGTLVTVSS

SEQ ID NO: 320 - protein, 125 aa, Artificial Sequence
  Description of Artificial Sequence: Synthetic polypeptide
EVQLVESGGGLVQPGGSLRLSCAASGRTFEKDAMGWFRQAPGKEREMVAAIRWSGGITCYADSVKGRFTISADNSKNTAYLQMNSLKPEDTAVYYCAAYGSLPDDYDGLECEYDWGQGTLVTVSS

SEQ ID NO: 321 - protein, 115 aa, Artificial Sequence
  Description of Artificial Sequence: Synthetic polypeptide
EVQLVESGGGLVQPGGSLRLSCAASGSFFKINAMGWFRQAPGKEREFVAGITRSGGSTYYADSVKGRFTISADNSKNTAYLQMNSLKPEDTAVYYCAAESLGRWWGQGTLVTVSS

SEQ ID NO: 322 - protein, 114 aa, Artificial Sequence
  Description of Artificial Sequence: Synthetic polypeptide
EVQLVESGGGLVQPGGSLRLSCAASGRTFSIDAMGWFRQAPGKEREFVAAIRWSGGITWYADSVKGRFTISADNSKNTAYLQMNSLKPEDTAVYYCAASHDSDWGQGTLVTVSS

SEQ ID NO: 323 - protein, 124 aa, Artificial Sequence
  Description of Artificial Sequence: Synthetic polypeptide
EVQLVESGGGLVQPGGSLRLSCAASGRTFSIDAMGWFRQAPGKEREFVAAIRWSGGITWYADSVKGRFTISADNSKNTAYLQMNSLKPEDTAVYYCAASHDSDYGGTNANLYDWGQGTLVTVSS

SEQ ID NO: 324 - protein, 122 aa, Artificial Sequence
  Description of Artificial Sequence: Synthetic polypeptide
EVQLVESGGGLVQPGGSLRLSCAASGRTDRSNVMGWFRQAPGKEREFVAAINRSGSTFYADSVKGRFTISADNSKNTAYLQMNSLKPEDTAVYYCAKTKRTGIFTTARMVDWGQGTLVTVSS

SEQ ID NO: 325 - protein, 123 aa, Artificial Sequence
  Description of Artificial Sequence: Synthetic polypeptide
EVQLVESGGGLVQPGGSLRLSCAASGSFFSINVMGWFRQAPGKERELVAATGRRGGPTYYADSVKGRFTISADNSKNTAYLQMNSLKPEDTAVYYCAAHRIVVGGTSVGDWRWGQGTLVTVSS

SEQ ID NO: 326 - protein, 116 aa, Artificial Sequence
  Description of Artificial Sequence: Synthetic polypeptide
EVQLVESGGGLVQPGGSLRLSCAASGFTWGDYTMGWFRQAPGKEREGVAAIDSDGRTRYADSVKGRFTISADNSKNTAYLQMNSLKPEDTAVYYCAAALDGYSGNWGQGTLVTVSS

SEQ ID NO: 327 - protein, 121 aa, Artificial Sequence
  Description of Artificial Sequence: Synthetic polypeptide
EVQLVESGGGLVQPGGSLRLSCAASGNIFSLNTMGWFRQAPGKEREFVAAINCSGNHPYYADSVKGRFTISADNSKNTAYLQMNSLKPEDTAVYYCAAIVTYSDDDGRDNWGQGTLVTVSS

SEQ ID NO: 328 - protein, 127 aa, Artificial Sequence
  Description of Artificial Sequence: Synthetic polypeptide
EVQLVESGGGLVQPGGSLRLSCAASGSIFSINAMGWFRQAPGKEREFVAAVSGSGDDTYYADSVKGRFTISADNSKNTAYLQMNSLKPEDTAVYYCAAVQAYSSSSDYYSQEGAYDWGQGTLVTVSS

SEQ ID NO: 329 - protein, 120 aa, Artificial Sequence
  Description of Artificial Sequence: Synthetic polypeptide
EVQLVESGGGLVQPGGSLRLSCAASGFTFPAYVMGWFRQAPGKERELLAVITRDGSTHYADSVKGRFTISADNSKNTAYLQMNSLKPEDTAVYYCAVNGRWRIWSSRNPWGQGTLVTVSS

SEQ ID NO: 330 - protein, 126 aa, Artificial Sequence
  Description of Artificial Sequence: Synthetic polypeptide
EVQLVESGGGLVQPGGSLRLSCAASGFSFDDDYVMGWFRQAPGKERELVAVIGWGGKETWYADSVKGRFTISADNSKNTAYLQMNSLKPEDTAVYYCAAEDPSMGYYTLEEYEYDWGQGTLVTVSS

SEQ ID NO: 331 - protein, 123 aa, Artificial Sequence
  Description of Artificial Sequence: Synthetic polypeptide
EVQLVESGGGLVQPGGSLRLSCAASGPTFDTYVMGWFRQAPGKEREFVAAISMSGDDTAYADSVKGRFTISADNSKNTAYLQMNSLKPEDTAVYYCATDLRGRGDVSEYEYDWGQGTLVTVSS

SEQ ID NO: 332 - protein, 118 aa, Artificial Sequence
  Description of Artificial Sequence: Synthetic polypeptide
EVQLVESGGGLVQPGGSLRLSCAASGRTFSIDAMGWFRQAPGKEREFVGAITWGGGNTYYADSVKGRFTISADNSKNTAYLQMNSLKPEDTAVYYCAAIVTDGDYDGWGQGTLVTVSS

SEQ ID NO: 333 - protein, 121 aa, Artificial Sequence
  Description of Artificial Sequence: Synthetic polypeptide
EVQLVESGGGLVQPGGSLRLSCAASGNTFSINVMGWFRQAPGKEREFVAAINWNGGSTDYADSVKGRFTISADNSKNTAYLQMNSLKPEDTAVYYCAAIVTYSDYDLDNDWGQGTLVTVSS

SEQ ID NO: 334 - protein, 122 aa, Artificial Sequence
  Description of Artificial Sequence: Synthetic polypeptide
EVQLVESGGGLVQPGGSLRLSCAASGFTFSTHWMGWFRQAPGKEREVVAVIYTSDGSTYYADSVKGRFTISADNSKNTAYLQMNSLKPEDTAVYYCAANEYGLGSSIYAYKWGQGTLVTVSS

SEQ ID NO: 335 - protein, 121 aa, Artificial Sequence
  Description of Artificial Sequence: Synthetic polypeptide
EVQLVESGGGLVQPGGSLRLSCAASGRTFSISAMGWFRQAPGKEREFVAAISRSGGTTYYADSVKGRFTISADNSKNTAYLQMNSLKPEDTAVYYCATDEDYALGPNEYDWGQGTLVTVSS

SEQ ID NO: 336 - protein, 129 aa, Artificial Sequence
  Description of Artificial Sequence: Synthetic polypeptide
EVQLVESGGGLVQPGGSLRLSCAASGSTFRINAMGWFRQAPGKERELVAAISPAALTTYYADSVKGRFTISADNSKNTAYLQMNSLKPEDTAVYYCAAEPYGSGSLYDDYDGLPIKYDWGQGTLVTVSS

SEQ ID NO: 337 - protein, 126 aa, Artificial Sequence
  Description of Artificial Sequence: Synthetic polypeptide
EVQLVESGGGLVQPGGSLRLSCAASGFTDGIDAMGWFRQAPGKEREFVAAISWSNDITYYADSVKGRFTISADNSKNTAYLQMNSLKPEDTAVYYCAAALSEVWRGSENLREGYDWGQGTLVTVSS

SEQ ID NO: 338 - protein, 123 aa, Artificial Sequence
  Description of Artificial Sequence: Synthetic polypeptide
EVQLVESGGGLVQPGGSLRLSCAASGLPVDYYAMGWFRQAPGKERELVAAISGSGDSTYYADSVKGRFTISADNSKNTAYLQMNSLKPEDTAVYYCAAQTEDSASIFGYGMDWGQGTLVTVSS

SEQ ID NO: 339 - protein, 123 aa, Artificial Sequence
  Description of Artificial Sequence: Synthetic polypeptide
EVQLVESGGGLVQPGGSLRLSCAASGRTLSTVNMGWFRQAPGKEREFVGAISRSGETTWYADSVKGRFTISADNSKNTAYLQMNSLKPEDTAVYYCAVDCPDYYSDYECPLEWGQGTLVTVSS

SEQ ID NO: 340 - protein, 118 aa, Artificial Sequence
  Description of Artificial Sequence: Synthetic polypeptide
EVQLVESGGGLVQPGGSLRLSCAASGFSFDDYAMGWFRQAPGKERELVAAVRWSGGITWYADSVKGRFTISADNSKNTAYLQMNSLKPEDTAVYYCAAGDTGGAAYGWGQGTLVTVSS

SEQ ID NO: 341 - protein, 117 aa, Artificial Sequence
  Description of Artificial Sequence: Synthetic polypeptide
EVQLVESGGGLVQPGGSLRLSCAASGSTLSINAMGWFRQAPGKEREGVSWISSSDGSTYYADSVKGRFTISADNSKNTAYLQMNSLKPEDTAVYYCAAALDGYSGRWGQGTLVTVSS

SEQ ID NO: 342 - protein, 128 aa, Artificial Sequence
  Description of Artificial Sequence: Synthetic polypeptide
EVQLVESGGGLVQPGGSLRLSCAASGSSVSIDAMGWFRQAPGKEREFVAGISRSGDTTYYADSVKGRFTISADNSKNTAYLQMNSLKPEDTAVYYCAASYNVYYNNYYYPISRDEYDWGQGTLVTVSS

SEQ ID NO: 343 - protein, 119 aa, Artificial Sequence
  Description of Artificial Sequence: Synthetic polypeptide
EVQLVESGGGLVQPGGSLRLSCAASGSIFRVNVMGWFRQAPGKERELVAVTWSGGSTNYADSVKGRFTISADNSKNTAYLQMNSLKPEDTAVYYCAAIAYEEGVYRWDWGQGTLVTVSS

SEQ ID NO: 344 - protein, 122 aa, Artificial Sequence
  Description of Artificial Sequence: Synthetic polypeptide
EVQLVESGGGLVQPGGSLRLSCAASGRTFSFYAMGWFRQAPGKEREFVAVVNWSGRRTYYADSVKGRFTISADNSKNTAYLQMNSLKPEDTAVYYCAASSRMGVDDPETYGWGQGTLVTVSS

SEQ ID NO: 345 - protein, 125 aa, Artificial Sequence
  Description of Artificial Sequence: Synthetic polypeptide
EVQLVESGGGLVQPGGSLRLSCAASGFTFDDAAMGWFRQAPGKEREFVAAVRWRGGITWYADSVKGRFTISADNSKNTAYLQMNSLKPEDTAVYYCAAQGSLYDDYDGLPIKYDWGQGTLVTVSS

SEQ ID NO: 346 - protein, 113 aa, Artificial Sequence
  Description of Artificial Sequence: Synthetic polypeptide
EVQLVESGGGLVQPGGSLRLSCAASGSIFRINAMGWFRQAPGKERELVASISRFGRTNYADSVKGRFTISADNSKNTAYLQMNSLKPEDTAVYYCAANGIESWGQGTLVTVSS

SEQ ID NO: 347 - protein, 116 aa, Artificial Sequence
  Description of Artificial Sequence: Synthetic polypeptide
EVQLVESGGGLVQPGGSLRLSCAASGFTWGDYTMGWFRQAPGKEREFVASITSGGRMWYADSVKGRFTISADNSKNTAYLQMNSLKPEDTAVYYCAAALDGYSGSWGQGTLVTVSS

SEQ ID NO: 348 - protein, 114 aa, Artificial Sequence
  Description of Artificial Sequence: Synthetic polypeptide
EVQLVESGGGLVQPGGSLRLSCAASGFRFSSYGMGWFRQAPGKEREGVAAIGSDGSTSYADSVKGRFTISADNSKNTAYLQMNSLKPEDTAVYYCASWDGRQVWGQGTLVTVSS

SEQ ID NO: 349 - protein, 116 aa, Artificial Sequence
  Description of Artificial Sequence: Synthetic polypeptide
EVQLVESGGGLVQPGGSLRLSCAASGRTFDNYNMGWFRQAPGKEREFVAAISWNGVTIYYADSVKGRFTISADNSKNTAYLQMNSLKPEDTAVYYCAAQGSLYDDWGQGTLVTVSS

SEQ ID NO: 350 - protein, 116 aa, Artificial Sequence
  Description of Artificial Sequence: Synthetic polypeptide
EVQLVESGGGLVQPGGSLRLSCAASGFTFSTYSMGWFRQAPGKEREFVAAISSGGLKAYADSVKGRFTISADNSKNTAYLQMNSLKPEDTAVYYCAAALDDYSGSWGQGTLVTVSS

SEQ ID NO: 351 - protein, 120 aa, Artificial Sequence
  Description of Artificial Sequence: Synthetic polypeptide
EVQLVESGGGLVQPGGSLRLSCAASGYTFRAYVMGWFRQAPGKERELLAVITRDGSTHYADSVKGRFTISADNSKNTAYLQMNSLKPEDTAVYYCAVNGRWRSWSSRNPWGQGTLVTVSS

SEQ ID NO: 352 - protein, 118 aa, Artificial Sequence
  Description of Artificial Sequence: Synthetic polypeptide
EVQLVESGGGLVQPGGSLRLSCAASGRTFSIYAMGWFRQAPGKEREFVAAISRGSNSTDYADSVKGRFTISADNSKNTAYLQMNSLKPEDTAVYYCAAIVTYTDYDLWGQGTLVTVSS

SEQ ID NO: 353 - protein, 118 aa, Artificial Sequence
  Description of Artificial Sequence: Synthetic polypeptide
EVQLVESGGGLVQPGGSLRLSCAASGRTISSYAMGWFRQAPGKERELVAAISKSSISTYYADSVKGRFTISADNSKNTAYLQMNSLKPEDTAVYYCALGPVRRSRLEWGQGTLVTVSS

SEQ ID NO: 354 - protein, 126 aa, Artificial Sequence
  Description of Artificial Sequence: Synthetic polypeptide
EVQLVESGGGLVQPGGSLRLSCAASGPTFDTYVMGWFRQAPGKEREFVAAISWTGDSSSDGDTYYADSVKGRFTISADNSKNTAYLQMNSLKPEDTAVYYCAAAIFDVTDYERADWGQGTLVTVSS

SEQ ID NO: 355 - protein, 115 aa, Artificial Sequence
  Description of Artificial Sequence: Synthetic polypeptide
EVQLVESGGGLVQPGGSLRLSCAASGFTLGNYAMGWFRQAPGKERELVSAITWSDGSSYYADSVKGRFTISADNSKNTAYLQMNSLKPEDTAVYYCASTRFAGRWGQGTLVTVSS

SEQ ID NO: 356 - protein, 126 aa, Artificial Sequence
  Description of Artificial Sequence: Synthetic polypeptide
EVQLVESGGGLVQPGGSLRLSCAASGNIDRLYAMGWFRQAPGKEREPVAAISPAAVTAGMTYYADSVKGRFTISADNSKNTAYLQMNSLKPEDTAVYYCAAYGSGSYYYTDDELDWGQGTLVTVSS

SEQ ID NO: 357 - protein, 124 aa, Artificial Sequence
  Description of Artificial Sequence: Synthetic polypeptide
EVQLVESGGGLVQPGGSLRLSCAASGRTFGRRAMGWFRQAPGKERELVAAIRWSGKETWYADSVKGRFTISADNSKNTAYLQMNSLKPEDTAVYYCAAGNGGRTYGHSRARYEWGQGTLVTVSS

SEQ ID NO: 358 - protein, 118 aa, Artificial Sequence
  Description of Artificial Sequence: Synthetic polypeptide
EVQLVESGGGLVQPGGSLRLSCAASGRTFSIGAMGWFRQAPGKEREYVGSITWRGGNTYYADSVKGRFTISADNSKNTAYLQMNSLKPEDTAVYYCAAGVTGGAAYGWGQGTLVTVSS

SEQ ID NO: 359 - protein, 116 aa, Artificial Sequence
  Description of Artificial Sequence: Synthetic polypeptide
EVQLVESGGGLVQPGGSLRLSCAASGLTFSTYWMGWFRQAPGKEREVVAVIYTSDGSTYYADSVKGRFTISADNSKNTAYLQMNSLKPEDTAVYYCATIDGSWREWGQGTLVTVSS

SEQ ID NO: 360 - protein, 126 aa, Artificial Sequence
  Description of Artificial Sequence: Synthetic polypeptide
EVQLVESGGGLVQPGGSLRLSCAASGFGIDFYAMGWFRQAPGKEREFVAAISGSGDDTYYADSVKGRFTISADNSKNTAYLQMNSLKPEDTAVYYCAASASDYGLGLELFHDEYNWGQGTLVTVSS

SEQ ID NO: 361 - protein, 121 aa, Artificial Sequence
  Description of Artificial Sequence: Synthetic polypeptide
EVQLVESGGGLVQPGGSLRLSCAASGNILSLNTMGWFRQAPGKEREFVASVTWGFGSTSYADSVKGRFTISADNSKNTAYLQMNSLKPEDTAVYYCAAIVTYSDYDLGNDWGQGTLVTVSS

SEQ ID NO: 362 - protein, 126 aa, Artificial Sequence
  Description of Artificial Sequence: Synthetic polypeptide
EVQLVESGGGLVQPGGSLRLSCAASGSIYSLDAMGWFRQAPGKEREFVAAISPAALTTYYADSVKGRFTISADNSKNTAYLQMNSLKPEDTAVYYCAGSSRIYIYSDSLSERSYDWGQGTLVTVSS

SEQ ID NO: 363 - protein, 119 aa, Artificial Sequence
  Description of Artificial Sequence: Synthetic polypeptide
EVQLVESGGGLVQPGGSLRLSCAASGRTFSFYGMGWFRQAPGKERELVAIKFSGGTTDYADSVKGRFTISADNSKNTAYLQMNSLKPEDTAVYYCAAIAHEEGVYRWDWGQGTLVTVSS

SEQ ID NO: 364 - protein, 118 aa, Artificial Sequence
  Description of Artificial Sequence: Synthetic polypeptide
EVQLVESGGGLVQPGGSLRLSCAASGRTFSKYAMGWFRQAPGKEREFVAAIRWSGGTTFYADSVKGRFTISADNSKNTAYLQMNSLKPEDTAVYYCAAGGWGTGRYNWGQGTLVTVSS

SEQ ID NO: 365 - protein, 116 aa, Artificial Sequence
  Description of Artificial Sequence: Synthetic polypeptide
EVQLVESGGGLVQPGGSLRLSCAASGSIFSIYAMDWFRQAPGKEREFVAAISSDDSTTYYADSVKGRFTISADNSKNTAYLQMNSLKPEDTAVYYCTAVLPAYDDWGQGTLVTVSS

SEQ ID NO: 366 - protein, 117 aa, Artificial Sequence
  Description of Artificial Sequence: Synthetic polypeptide
EVQLVESGGGLVQPGGSLRLSCAASGFNSGSYTMGWFRQAPGKEREGVSYISSSDGRTYYADSVKGRFTISADNSKNTAYLQMNSLKPEDTAVYYCAAGLNGAAAAWGQGTLVTVSS

SEQ ID NO: 367 - protein, 114 aa, Artificial Sequence
  Description of Artificial Sequence: Synthetic polypeptide
EVQLVESGGGLVQPGGSLRLSCAASGRTFSNGPMGWFRQAPGKEREFVAHISTGGATNYADSVKGRFTISADNSKNTAYLQMNSLKPEDTAVYYCASWDGRQGWGQGTLVTVSS

SEQ ID NO: 368 - protein, 117 aa, Artificial Sequence
  Description of Artificial Sequence: Synthetic polypeptide
EVQLVESGGGLVQPGGSLRLSCAASGRALSSYSMGWFRQAPGKEREFVALITRSGGTTFYADSVKGRFTISADNSKNTAYLQMNSLKPEDTAVYYCALDNRHSYVDWGQGTLVTVSS

SEQ ID NO: 369 - protein, 121 aa, Artificial Sequence
  Description of Artificial Sequence: Synthetic polypeptide
EVQLVESGGGLVQPGGSLRLSCAASGSIGSINAMGWFRQAPGKEREFVAAISWSGGATNYADSVKGRFTISADNSKNTAYLQMNSLKPEDTAVYYCAASVAYSDYDLGNDWGQGTLVTVSS

SEQ ID NO: 370 - protein, 121 aa, Artificial Sequence
  Description of Artificial Sequence: Synthetic polypeptide
EVQLVESGGGLVQPGGSLRLSCAASGLSFDDYAMGWFRQAPGKEREFVAAISGRSGNTYYADSVKGRFTISADNSKNTAYLQMNSLKPEDTAVYYCALIQRRAPYSRLETWGQGTLVTVSS

SEQ ID NO: 371 - protein, 119 aa, Artificial Sequence
  Description of Artificial Sequence: Synthetic polypeptide
EVQLVESGGGLVQPGGSLRLSCAASGFTFSIYAMGWFRQAPGKEREGVAAISWSGGTTYYADSVKGRFTISADNSKNTAYLQMNSLKPEDTAVYYCAAAAGWVAEYGYWGQGTLVTVSS

SEQ ID NO: 372 - protein, 123 aa, Artificial Sequence
  Description of Artificial Sequence: Synthetic polypeptide
EVQLVESGGGLVQPGGSLRLSCAASGGTFSSYAMGWFRQAPGKEREFVATISSNGNTTYYADSVKGRFTISADNSKNTAYLQMNSLKPEDTAVYYCAADLRVLRLRRYEYNYWGQGTLVTVSS

SEQ ID NO: 373 - protein, 116 aa, Artificial Sequence
  Description of Artificial Sequence: Synthetic polypeptide
EVQLVESGGGLVQPGGSLRLSCAASGFTFRSNAMGWFRQAPGKEREGVAAISTSGGITYYADSVKGRFTISADNSKNTAYLQMNSLKPEDTAVYYCAAERDGYGYWGQGTLVTVSS

SEQ ID NO: 374 - protein, 116 aa, Artificial Sequence
  Description of Artificial Sequence: Synthetic polypeptide
EVQLVESGGGLVQPGGSLRLSCAASGFTFDDYAMGWFRQAPGKERELVAGISWNGGITYYADSVKGRFTISADNSKNTAYLQMNSLKPEDTAVYYCAVVRAGYDYWGQGTLVTVSS

SEQ ID NO: 375 - protein, 116 aa, Artificial Sequence
  Description of Artificial Sequence: Synthetic polypeptide
EVQLVESGGGLVQPGGSLRLSCAASGSTFSIYAMGWFRQAPGKEREWVATISWSGGSTNYADSVKGRFTISADNSKNTAYLQMNSLKPEDTAVYYCAVGRSGRDYWGQGTLVTVSS

SEQ ID NO: 376 - protein, 118 aa, Artificial Sequence
  Description of Artificial Sequence: Synthetic polypeptide
EVQLVESGGGLVQPGGSLRLSCAASGRAFESYAMGWFRQAPGKEREFVAAIRWSGGSTYYADSVKGRFTISADNSKNTAYLQMNSLKPEDTAVYYCATGGWGTGRYNWGQGTLVTVSS

SEQ ID NO: 377 - protein, 119 aa, Artificial Sequence
  Description of Artificial Sequence: Synthetic polypeptide
EVQLVESGGGLVQPGGSLRLSCAASGRIFSDYAMGWFRQAPGKEREFVATINGDGDSTNYADSVKGRFTISADNSKNTAYLQMNSLKPEDTAVYYCAANTYWYYTYDSWGQGTLVTVSS

SEQ ID NO: 378 - protein, 119 aa, Artificial Sequence
  Description of Artificial Sequence: Synthetic polypeptide
EVQLVESGGGLVQPGGSLRLSCAASGRIFSDYAMGWFRQAPGKEREFVATINGDGDSTNYADSVKGRFTISADNSKNTAYLQMNSLKPEDTAVYYCAANTYCNYTYDSWGQGTLVTVSS

SEQ ID NO: 379 - protein, 118 aa, Artificial Sequence
  Description of Artificial Sequence: Synthetic polypeptide
EVQLVESGGGLVQPGGSLRLSCAASGRTLSRSNMGWFRQAPGKEREFVAAVRWSGGITWYADSVKGRFTISADNSKNTAYLQMNSLKPEDTAVYYCALGPVRRSRLEWGQGTLVTVSS

SEQ ID NO: 380 - protein, 116 aa, Artificial Sequence
  Description of Artificial Sequence: Synthetic polypeptide
EVQLVESGGGLVQPGGSLRLSCAASGFTFSTYAMGWFRQAPGKEREFVAAITWSGGSTNYADSVKGRFTISADNSKNTAYLQMNSLKPEDTAVYYCAAGRAGRDSWGQGTLVTVSS

SEQ ID NO: 381 - protein, 117 aa, Artificial Sequence
  Description of Artificial Sequence: Synthetic polypeptide
EVQLVESGGGLVQPGGSLRLSCAASGRTFNSYAMGWFRQAPGKEREFVAGITRSAVSTSYADSVKGRFTISADNSKNTAYLQMNSLKPEDTAVYYCAAFRGIMRPDWGQGTLVTVSS

SEQ ID NO: 382 - protein, 117 aa, Artificial Sequence
  Description of Artificial Sequence: Synthetic polypeptide
EVQLVESGGGLVQPGGSLRLSCAASGFTFRNYVMGWFRQAPGKEREFVASITWSGGTTYYADSVKGRFTISADNSKNTAYLQMNSLKPEDTAVYYCAAGRGSGRDYWGQGTLVTVSS

SEQ ID NO: 383 - protein, 117 aa, Artificial Sequence
  Description of Artificial Sequence: Synthetic polypeptide
EVQLVESGGGLVQPGGSLRLSCAASGRALSSNSMGWFRQAPGKEREFVALITRSGGTTFYADSVKGRFTISADNSKNTAYLQMNSLKPEDTAVYYCALNNRRRYVDWGQGTLVTVSS

SEQ ID NO: 384 - protein, 116 aa, Artificial Sequence
  Description of Artificial Sequence: Synthetic polypeptide
EVQLVESGGGLVQPGGSLRLSCAASGRTFSSYAMGWFRQAPGKEREFVAAISWSGGSTYYADSVKGRFTISADNSKNTAYLQMNSLKPEDTAVYYCAVGRNGRDYWGQGTLVTVSS

SEQ ID NO: 385 - protein, 121 aa, Artificial Sequence
  Description of Artificial Sequence: Synthetic polypeptide
EVQLVESGGGLVQPGGSLRLSCAASGSTFSIYAMGWFRQAPGKEREFVAAISWSGGNTYYADSVKGRFTISADNSKNTAYLQMNSLKPEDTAVYYCAAVPTIAYNTGYDYWGQGTLVTVSS

SEQ ID NO: 386 - protein, 118 aa, Artificial Sequence
  Description of Artificial Sequence: Synthetic polypeptide
EVQLVESGGGLVQPGGSLRLSCAASGRTFDDYAMGWFRQAPGKERELVSGITWSGGSTYYADSVKGRFTISADNSKNTAYLQMNSLKPEDTAVYYCAAVLGYDGYDYWGQGTLVTVSS

SEQ ID NO: 387 - protein, 123 aa, Artificial Sequence
  Description of Artificial Sequence: Synthetic polypeptide
EVQLVESGGGLVQPGGSLRLSCAASGRTFSIYAMGWFRQAPGKERELVSAISTDDGSTYYADSVKGRFTISADNSKNTAYLQMNSLKPEDTAVYYCAAALPDDTYLATTYDYWGQGTLVTVSS

SEQ ID NO: 388 - protein, 123 aa, Artificial Sequence
  Description of Artificial Sequence: Synthetic polypeptide
EVQLVESGGGLVQPGGSLRLSCAASGSIFSDNVMGWFRQAPGKEREMVAAIRWSGGITWYADSVKGRFTISADNSKNTAYLQMNSLKPEDTAVYYCATDLSGRGDVSEYEYDWGQGTLVTVSS

SEQ ID NO: 389 - protein, 117 aa, Artificial Sequence
  Description of Artificial Sequence: Synthetic polypeptide
EVQLVESGGGLVQPGGSLRLSCAASGEIASIIAMGWFRQAPGKEREWVSAINSGGDTYYADSVKGRFTISADNSKNTAYLQMNSLKPEDTAVYYCAADRSRTIWPDWGQGTLVTVSS

SEQ ID NO: 390 - protein, 116 aa, Artificial Sequence
  Description of Artificial Sequence: Synthetic polypeptide
EVQLVESGGGLVQPGGSLRLSCAASGRTFSVSTMGWFRQAPGKEREIVAAITWSGSATYYADSVKGRFTISADNSKNTAYLQMNSLKPEDTAVYYCAAQRRWSQDWGQGTLVTVSS

SEQ ID NO: 391 - protein, 117 aa, Artificial Sequence
  Description of Artificial Sequence: Synthetic polypeptide
EVQLVESGGGLVQPGGSLRLSCAASGRTFSSYAMGWFRQAPGKERELVAGITGGGSSTYYADSVKGRFTISADNSKNTAYLQMNSLKPEDTAVYYCAAVTRYGYDYWGQGTLVTVSS

SEQ ID NO: 392 - protein, 124 aa, Artificial Sequence
  Description of Artificial Sequence: Synthetic polypeptide
EVQLVESGGGLVQPGGSLRLSCAASGIPFRSRTMGWFRQAPGKEREFVAGITRNSIRTRYADSVKGRFTISADNSKNTAYLQMNSLKPEDTAVYYCAAAPRRPYLPIRIRDYIWGQGTLVTVSS

SEQ ID NO: 393 - protein, 120 aa, Artificial Sequence
  Description of Artificial Sequence: Synthetic polypeptide
EVQLVESGGGLVQPGGSLRLSCAASGRTIVPYTMGWFRQAPGKEREFVAAISWSGASTIYADSVKGRFTISADNSKNTAYLQMNSLKPEDTAVYYCAIGGTLYDRRRFEWGQGTLVTVSS

SEQ ID NO: 394 - protein, 116 aa, Artificial Sequence
  Description of Artificial Sequence: Synthetic polypeptide
EVQLVESGGGLVQPGGSLRLSCAASGFTFSNNAMGWFRQAPGKEREGVAAINGSGSITYYADSVKGRFTISADNSKNTAYLQMNSLKPEDTAVYYCAAARDDYGYWGQGTLVTVSS

SEQ ID NO: 395 - protein, 117 aa, Artificial Sequence
  Description of Artificial Sequence: Synthetic polypeptide
EVQLVESGGGLVQPGGSLRLSCAASGRTFSIYGMGWFRQAPGKEREGVAGISWSDGSTSYADSVKGRFTISADNSKNTAYLQMNSLKPEDTAVYYCAAASDASFDYWGQGTLVTVSS

SEQ ID NO: 396 - protein, 116 aa, Artificial Sequence
  Description of Artificial Sequence: Synthetic polypeptide
EVQLVESGGGLVQPGGSLRLSCAASGGTFSDYGMGWFRQAPGKEREGVASISWNDGSTSYADSVKGRFTISADNSKNTAYLQMNSLKPEDTAVYYCAAATADYDYWGQGTLVTVSS

SEQ ID NO: 397 - protein, 122 aa, Artificial Sequence
  Description of Artificial Sequence: Synthetic polypeptide
EVQLVESGGGLVQPGGSLRLSCAASGSTFSTYAMGWFRQAPGKERELVAAISWSSGTTYYADSVKGRFTISADNSKNTAYLQMNSLKPEDTAVYYCAAVLVTSDGVSEYNYWGQGTLVTVSS

SEQ ID NO: 398 - protein, 126 aa, Artificial Sequence
  Description of Artificial Sequence: Synthetic polypeptide
EVQLVESGGGLVQPGGSLRLSCAASGFLFDSYAMGWFRQAPGKEREPVAAISPAALTTYYADSVKGRFTISADNSKNTAYLQMNSLKPEDTAVYYCAAYYTDYDEALEETRGSYDWGQGTLVTVSS

SEQ ID NO: 399 - protein, 116 aa, Artificial Sequence
  Description of Artificial Sequence: Synthetic polypeptide
EVQLVESGGGLVQPGGSLRLSCAASGFTLSNYAMGWFRQAPGKEREGVAAISWNSGSTYYADSVKGRFTISADNSKNTAYLQMNSLKPEDTAVYYCATDARRYGYWGQGTLVTVSS

SEQ ID NO: 400 - protein, 121 aa, Artificial Sequence
  Description of Artificial Sequence: Synthetic polypeptide
EVQLVESGGGLVQPGGSLRLSCAASGSTFGNYAMGWFRQAPGKEREFVAAISRSGSITYYADSVKGRFTISADNSKNTAYLQMNSLKPEDTAVYYCATDEDYALGPNEYDWGQGTLVTVSS

SEQ ID NO: 401 - protein, 117 aa, Artificial Sequence
  Description of Artificial Sequence: Synthetic polypeptide
EVQLVESGGGLVQPGGSLRLSCAASGRTFSIYAMGWFRQAPGKERELVAGISWGGDSTYYADSVKGRFTISADNSKNTAYLQMNSLKPEDTAVYYCAAVAGNGYDYWGQGTLVTVSS

SEQ ID NO: 402 - protein, 117 aa, Artificial Sequence
  Description of Artificial Sequence: Synthetic polypeptide
EVQLVESGGGLVQPGGSLRLSCAASGFNSGSYTMGWFRQAPGKEREGVSYISSSDGRTYYADSVKGRFTISADNSKNTAYLQMNSLKPEDTAVYYCAAALDGYSGSWGQGTLVTVSS

SEQ ID NO: 403 - protein, 115 aa, Artificial Sequence
  Description of Artificial Sequence: Synthetic polypeptide
EVQLVESGGGLVQPGGSLRLSCAASGLTFWTSGMGWFRQAPGKEREYVAAISRSGSLKGYADSVKGRFTISADNSKNTAYLQMNSLKPEDTAVYYCATVATALIWGQGTLVTVSS

SEQ ID NO: 404 - protein, 117 aa, Artificial Sequence
  Description of Artificial Sequence: Synthetic polypeptide
EVQLVESGGGLVQPGGSLRLSCAASGFTFSINAMGWFRQAPGKERELVSGISWGGGSTYYADSVKGRFTISADNSKNTAYLQMNSLKPEDTAVYYCAAVNEDGFDYWGQGTLVTVSS

SEQ ID NO: 405 - protein, 116 aa, Artificial Sequence
  Description of Artificial Sequence: Synthetic polypeptide
EVQLVESGGGLVQPGGSLRLSCAASGFTFDDNAMGWFRQAPGKERELVAAISTSGSNTYYADSVKGRFTISADNSKNTAYLQMNSLKPEDTAVYYCAAELREYGYWGQGTLVTVSS

SEQ ID NO: 406 - protein, 115 aa, Artificial Sequence
  Description of Artificial Sequence: Synthetic polypeptide
EVQLVESGGGLVQPGGSLRLSCAASGRTFTSYNMGWFRQAPGKEREFLGSILWSDDSTNYADSVKGRFTISADNSKNTAYLQMNSLKPEDTAVYYCASWDGRQVWGQGTLVTVSS

SEQ ID NO: 407 - protein, 116 aa, Artificial Sequence
  Description of Artificial Sequence: Synthetic polypeptide
EVQLVESGGGLVQPGGSLRLSCAASGFTFRNYVMGWFRQAPGKEREFVAAINWNGSITYYADSVKGRFTISADNSKNTAYLQMNSLKPEDTAVYYCAAGRSARNYWGQGTLVTVSS

SEQ ID NO: 408 - protein, 121 aa, Artificial Sequence
  Description of Artificial Sequence: Synthetic polypeptide
EVQLVESGGGLVQPGGSLRLSCAASGRTFSSYAMGWFRQAPGKEREFVAAISTSGGITYYADSVKGRFTISADNSKNTAYLQMNSLKPEDTAVYYCATDRIEYSRGGYDYWGQGTLVTVSS

SEQ ID NO: 409 - protein, 117 aa, Artificial Sequence
  Description of Artificial Sequence: Synthetic polypeptide
EVQLVESGGGLVQPGGSLRLSCAASGSTFRKYAMGWFRQAPGKEREFVAAISSGGGSTNYADSVKGRFTISADNSKNTAYLQMNSLKPEDTAVYYCAAGRYRERDSWGQGTLVTVSS

SEQ ID NO: 410 - protein, 123 aa, Artificial Sequence
  Description of Artificial Sequence: Synthetic polypeptide
EVQLVESGGGLVQPGGSLRLSCAASGSTFSIYAMGWFRQAPGKEREFVAAISWSGDTTYYADSVKGRFTISADNSKNTAYLQMNSLKPEDTAVYYCAIDLPDDTYLATEYDYWGQGTLVTVSS

SEQ ID NO: 411 - protein, 119 aa, Artificial Sequence
  Description of Artificial Sequence: Synthetic polypeptide
EVQLVESGGGLVQPGGSLRLSCAASGSGFSPNVMGWFRQAPGKERELVAIKFSGGTTDYADSVKGRFTISADNSKNTAYLQMNSLKPEDTAVYYCAAIAYEEGVYRWDWGQGTLVTVSS

SEQ ID NO: 412 - protein, 117 aa, Artificial Sequence
  Description of Artificial Sequence: Synthetic polypeptide
EVQLVESGGGLVQPGGSLRLSCAASGRTLTNHDMGWFRQAPGKEREGVSYISMSDGRTYYADSVKGRFTISADNSKNTAYLQMNSLKPEDTAVYYCAAVLDGYSGSWGQGTLVTVSS

SEQ ID NO: 413 - protein, 117 aa, Artificial Sequence
  Description of Artificial Sequence: Synthetic polypeptide
EVQLVESGGGLVQPGGSLRLSCAASGSTFSIYAMGWFRQAPGKEREFVAAISRSGDSTYYADSVKGRFTISADNSKNTAYLQMNSLKPEDTAVYYCAAVTLDNYGYWGQGTLVTVSS

SEQ ID NO: 414 - protein, 126 aa, Artificial Sequence
  Description of Artificial Sequence: Synthetic polypeptide
EVQLVESGGGLVQPGGSLRLSCAASGGTASSYHMGWFRQAPGKEREFVAFIHRSGTSTYYADSVKGRFTISADNSKNTAYLQMNSLKPEDTAVYYCAADSITDRRSVAVAHTSYYWGQGTLVTVSS

SEQ ID NO: 415 - protein, 119 aa, Artificial Sequence
  Description of Artificial Sequence: Synthetic polypeptide
EVQLVESGGGLVQPGGSLRLSCAASGLTFSTYAMGWFRQAPGKEREIVAAITWSGGITYYADSVKGRFTISADNSKNTAYLQMNSLKPEDTAVYYCAAHGSILLDRIEWGQGTLVTVSS

SEQ ID NO: 416 - protein, 122 aa, Artificial Sequence
  Description of Artificial Sequence: Synthetic polypeptide
EVQLVESGGGLVQPGGSLRLSCAASGGTFSIYAMGWFRQAPGKERELVAAISSSGSITYYADSVKGRFTISADNSKNTAYLQMNSLKPEDTAVYYCAAAAALDGPGDMYDYWGQGTLVTVSS

SEQ ID NO: 417 - protein, 120 aa, Artificial Sequence
  Description of Artificial Sequence: Synthetic polypeptide
EVQLVESGGGLVQPGGSLRLSCAASGGTFDNYAMGWFRQAPGKERELVSGINSDGGSTYYADSVKGRFTISADNSKNTAYLQMNSLKPEDTAVYYCAAVPISSPSDRNYWGQGTLVTVSS

SEQ ID NO: 418 - protein, 120 aa, Artificial Sequence
  Description of Artificial Sequence: Synthetic polypeptide
EVQLVESGGGLVQPGGSLRLSCAASGRTFSLTAMGWFRQAPGKEREFVAAISPAALTTYYADSVKGRFTISADNSKNTAYLQMNSLKPEDTAVYYCASRRAFRLSSDYEWGQGTLVTVSS

SEQ ID NO: 419 - protein, 120 aa, Artificial Sequence
  Description of Artificial Sequence: Synthetic polypeptide
EVQLVESGGGLVQPGGSLRLSCAASGRNLRMYRMGWFRQAPGKEREFVAAVNWNGDSTYYADSVKGRFTISADNSKNTAYLQMNSLKPEDTAVYYCAANWKMLLGVENDWGQGTLVTVSS

SEQ ID NO: 420 - protein, 116 aa, Artificial Sequence
  Description of Artificial Sequence: Synthetic polypeptide
EVQLVESGGGLVQPGGSLRLSCAASGFTFDIYAMGWFRQAPGKERELVAGISSSGGSTYYADSVKGRFTISADNSKNTAYLQMNSLKPEDTAVYYCAAVLGTYDYWGQGTLVTVSS

SEQ ID NO: 421 - protein, 118 aa, Artificial Sequence
  Description of Artificial Sequence: Synthetic polypeptide
EVQLVESGGGLVQPGGSLRLSCAASGRTFDIYAMGWFRQAPGKERELVAAINRDDSSTYYADSVKGRFTISADNSKNTAYLQMNSLKPEDTAVYYCAAVAGLGNYNYWGQGTLVTVSS

SEQ ID NO: 422 - protein, 116 aa, Artificial Sequence
  Description of Artificial Sequence: Synthetic polypeptide
EVQLVESGGGLVQPGGSLRLSCAASGRSFSFNAMGWFRQAPGKERELVAAITKLGFRNYADSVKGRFTISADNSKNTAYLQMNSLKPEDTAVYYCAASIEGVSGRWGQGTLVTVSS

SEQ ID NO: 423 - protein, 123 aa, Artificial Sequence
  Description of Artificial Sequence: Synthetic polypeptide
EVQLVESGGGLVQPGGSLRLSCAASGSFFSINAMGWFRQAPGKERELVSASTWNGGYTYYADSVKGRFTISADNSKNTAYLQMNSLKPEDTAVYYCAAHRIVVGGTSVGDWRWGQGTLVTVSS

SEQ ID NO: 424 - protein, 127 aa, Artificial Sequence
  Description of Artificial Sequence: Synthetic polypeptide
EVQLVESGGGLVQPGGSLRLSCAASGRTFSDYAMGWFRQAPGKEREFVAGITSSGGYTYYADSVKGRFTISADNSKNTAYLQMNSLKPEDTAVYYCAAVVYYGDWEGSEPVQHEYDWGQGTLVTVSS

SEQ ID NO: 425 - protein, 123 aa, Artificial Sequence
  Description of Artificial Sequence: Synthetic polypeptide
EVQLVESGGGLVQPGGSLRLSCAASGSIFSRNAMGWFRQAPGKEREFVAAIRWSGKETWYADSVKGRFTISADNSKNTAYLQMNSLKPEDTAVYYCAKTKRTGIFTTARMVDWGQGTLVTVSS

SEQ ID NO: 426 - protein, 119 aa, Artificial Sequence
  Description of Artificial Sequence: Synthetic polypeptide
EVQLVESGGGLVQPGGSLRLSCAASGGTFDTYAMGWFRQAPGKEREFVAGISGDGTITYYADSVKGRFTISADNSKNTAYLQMNSLKPEDTAVYYCATDNPYWSGYNYWGQGTLVTVSS

SEQ ID NO: 427 - protein, 118 aa, Artificial Sequence
  Description of Artificial Sequence: Synthetic polypeptide
EVQLVESGGGLVQPGGSLRLSCAASGGTFSNYAMGWFRQAPGKERELVSGINSDGGSTYYADSVKGRFTISADNSKNTAYLQMNSLKPEDTAVYYCAAVSTNDGYDYWGQGTLVTVSS

SEQ ID NO: 428 - protein, 119 aa, Artificial Sequence
  Description of Artificial Sequence: Synthetic polypeptide
EVQLVESGGGLVQPGGSLRLSCAASGGIYRVNTMGWFRQAPGKERELVAIKFSGGTTDYADSVKGRFTISADNSKNTAYLQMNSLKPEDTAVYYCAAIAHEEGVYRWDWGQGTLVTVSS

SEQ ID NO: 429 - protein, 117 aa, Artificial Sequence
  Description of Artificial Sequence: Synthetic polypeptide
EVQLVESGGGLVQPGGSLRLSCAASGFTFSTYAMGWFRQAPGKERELVAGISSSGSSTYYADSVKGRFTISADNSKNTAYLQMNSLKPEDTAVYYCAVVSDGGYDYWGQGTLVTVSS

SEQ ID NO: 430 - protein, 121 aa, Artificial Sequence
  Description of Artificial Sequence: Synthetic polypeptide
EVQLVESGGGLVQPGGSLRLSCAASGRTSSIYNMGWFRQAPGKEREFVAAISRSGRSTSYADSVKGRFTISADNSKNTAYLQMNSLKPEDTAVYYCAAIVTYSDYDLGNDWGQGTLVTVSS

SEQ ID NO: 431 - protein, 117 aa, Artificial Sequence
  Description of Artificial Sequence: Synthetic polypeptide
EVQLVESGGGLVQPGGSLRLSCAASGRALSSYSMGWFRQAPGKEREFVALITRSGGTTFYADSVKGRFTISADNSKNTAYLQMNSLKPEDTAVYYCALDNRRSYVDWGQGTLVTVSS

SEQ ID NO: 432 - protein, 124 aa, Artificial Sequence
  Description of Artificial Sequence: Synthetic polypeptide
EVQLVESGGGLVQPGGSLRLSCAASGRALSRYGMVWFRQAPGKEREFVAAINRGGKISHYADSVKGRFTISADNSKNTAYLQMNSLKPEDTAVYYCAAGNGGRNYGHSRARYEWGQGTLVTVSS

SEQ ID NO: 433 - protein, 115 aa, Artificial Sequence
  Description of Artificial Sequence: Synthetic polypeptide
EVQLVESGGGLVQPGGSLRLSCAASGFKFNDSYMRWFRQAPGKEREFVVAINWSSGSTYYADSVKGRFTISADNSKNTAYLQMNSLKPEDTAVYYCAVVNGPIFWGQGTLVTVSS

SEQ ID NO: 434 - protein, 116 aa, Artificial Sequence
  Description of Artificial Sequence: Synthetic polypeptide
EVQLVESGGGLVQPGGSLRLSCAASGRTLSDYALGWFRQAPGKERELVSGINTSGDTTYYADSVKGRFTISADNSKNTAYLQMNSLKPEDTAVYYCAVVTSSYDYWGQGTLVTVSS

SEQ ID NO: 435 - protein, 117 aa, Artificial Sequence
  Description of Artificial Sequence: Synthetic polypeptide
EVQLVESGGGLVQPGGSLRLSCAASGSTFDIYGMGWFRQAPGKEREGVAAITGDGSSTSYADSVKGRFTISADNSKNTAYLQMNSLKPEDTAVYYCAADNDTEYGYWGQGTLVTVSS

SEQ ID NO: 436 - protein, 117 aa, Artificial Sequence
  Description of Artificial Sequence: Synthetic polypeptide
EVQLVESGGGLVQPGGSLRLSCAASGGTLDIYAMGWFRQAPGKEREFVAAISWSGSTTYYADSVKGRFTISADNSKNTAYLQMNSLKPEDTAVYYCAAVLGYDRDYWGQGTLVTVSS

SEQ ID NO: 437 - protein, 125 aa, Artificial Sequence
  Description of Artificial Sequence: Synthetic polypeptide
EVQLVESGGGLVQPGGSLRLSCAASGRPYSYDAMGWFRQAPGKEREIVAAISRTGSSIYYADSVKGRFTISADNSKNTAYLQMNSLKPEDTAVYYCAAQGSLYDDYDGLPIKYDWGQGTLVTVSS

SEQ ID NO: 438 - protein, 122 aa, Artificial Sequence
  Description of Artificial Sequence: Synthetic polypeptide
EVQLVESGGGLVQPGGSLRLSCAASGRTFRTYGMGWFRQAPGKEREGVAAISWSGNSTSYADSVKGRFTISADNSKNTAYLQMNSLKPEDTAVYYCAARLSKRGNRSSRDYWGQGTLVTVSS

SEQ ID NO: 439 - protein, 118 aa, Artificial Sequence
  Description of Artificial Sequence: Synthetic polypeptide
EVQLVESGGGLVQPGGSLRLSCAASGSTFDNYAMGWFRQAPGKERELVAGINWSDSSTYYADSVKGRFTISADNSKNTAYLQMNSLKPEDTAVYYCAAVAGWGEYDYWGQGTLVTVSS

SEQ ID NO: 440 - protein, 118 aa, Artificial Sequence
  Description of Artificial Sequence: Synthetic polypeptide
EVQLVESGGGLVQPGGSLRLSCAASGSTFSIYAMGWFRQAPGKERELVAGINWSDSSTYYADSVKGRFTISADNSKNTAYLQMNSLKPEDTAVYYCAAVTDYDEYNYWGQGTLVTVSS

SEQ ID NO: 441 - protein, 8 aa, Artificial Sequence
  Description of Artificial Sequence: Synthetic peptide
GFTFSSYG

SEQ ID NO: 442 - protein, 8 aa, Artificial Sequence
  Description of Artificial Sequence: Synthetic peptide
GFTFSDYG

SEQ ID NO: 443 - protein, 8 aa, Artificial Sequence
  Description of Artificial Sequence: Synthetic peptide
GFTFSDYG

SEQ ID NO: 444 - protein, 8 aa, Artificial Sequence
  Description of Artificial Sequence: Synthetic peptide
GFTFSDYG

SEQ ID NO: 445 - protein, 8 aa, Artificial Sequence
  Description of Artificial Sequence: Synthetic peptide
GFTFSDYG

SEQ ID NO: 446 - protein, 8 aa, Artificial Sequence
  Description of Artificial Sequence: Synthetic peptide
GFTFSDYG

SEQ ID NO: 447 - protein, 8 aa, Artificial Sequence
  Description of Artificial Sequence: Synthetic peptide
GFTFSDYG

SEQ ID NO: 448 - protein, 8 aa, Artificial Sequence
  Description of Artificial Sequence: Synthetic peptide
GFTFSDYG

SEQ ID NO: 449 - protein, 8 aa, Artificial Sequence
  Description of Artificial Sequence: Synthetic peptide
GFTFSDYG

SEQ ID NO: 450 - protein, 8 aa, Artificial Sequence
  Description of Artificial Sequence: Synthetic peptide
GFTFSDYG

SEQ ID NO: 451 - protein, 8 aa, Artificial Sequence
  Description of Artificial Sequence: Synthetic peptide
GFTFSDYG

SEQ ID NO: 452 - protein, 8 aa, Artificial Sequence
  Description of Artificial Sequence: Synthetic peptide
GFTFSDYG

SEQ ID NO: 453 - protein, 8 aa, Artificial Sequence
  Description of Artificial Sequence: Synthetic peptide
GFTFSDYG

SEQ ID NO: 454 - protein, 8 aa, Artificial Sequence
  Description of Artificial Sequence: Synthetic peptide
GFTFSDYG

SEQ ID NO: 455 - protein, 8 aa, Artificial Sequence
  Description of Artificial Sequence: Synthetic peptide
GFTFSDYG

SEQ ID NO: 456 - protein, 8 aa, Artificial Sequence
  Description of Artificial Sequence: Synthetic peptide
GFTFSDYG

SEQ ID NO: 457 - protein, 8 aa, Artificial Sequence
  Description of Artificial Sequence: Synthetic peptide
GFTFSDYG

SEQ ID NO: 458 - protein, 8 aa, Artificial Sequence
  Description of Artificial Sequence: Synthetic peptide
GFTFSDYG

SEQ ID NO: 459 - protein, 8 aa, Artificial Sequence
  Description of Artificial Sequence: Synthetic peptide
GFTFSDYG

SEQ ID NO: 460 - protein, 8 aa, Artificial Sequence
  Description of Artificial Sequence: Synthetic peptide
GFTFSDYG

SEQ ID NO: 461 - protein, 8 aa, Artificial Sequence
  Description of Artificial Sequence: Synthetic peptide
GFTFSDYG

SEQ ID NO: 462 - protein, 8 aa, Artificial Sequence
  Description of Artificial Sequence: Synthetic peptide
GFTFSDYG

SEQ ID NO: 463 - protein, 8 aa, Artificial Sequence
  Description of Artificial Sequence: Synthetic peptide
GFTFSDYG

SEQ ID NO: 464 - protein, 8 aa, Artificial Sequence
  Description of Artificial Sequence: Synthetic peptide
GFTFSDYG

SEQ ID NO: 465 - protein, 8 aa, Artificial Sequence
  Description of Artificial Sequence: Synthetic peptide
GFTFSDYG

SEQ ID NO: 466 - protein, 8 aa, Artificial Sequence
  Description of Artificial Sequence: Synthetic peptide
GFTFSDYG

SEQ ID NO: 467 - protein, 8 aa, Artificial Sequence
  Description of Artificial Sequence: Synthetic peptide
GFTFSDYG

SEQ ID NO: 468 - protein, 8 aa, Artificial Sequence
  Description of Artificial Sequence: Synthetic peptide
GFTFSDYG

SEQ ID NO: 469 - protein, 8 aa, Artificial Sequence
  Description of Artificial Sequence: Synthetic peptide
GFTFSDYG

SEQ ID NO: 470 - protein, 8 aa, Artificial Sequence
  Description of Artificial Sequence: Synthetic peptide
GFTFSDYG

SEQ ID NO: 471 - protein, 8 aa, Artificial Sequence
  Description of Artificial Sequence: Synthetic peptide
GFTFSDYG

SEQ ID NO: 472 - protein, 8 aa, Artificial Sequence
  Description of Artificial Sequence: Synthetic peptide
GFTFSDYG

SEQ ID NO: 473 - protein, 8 aa, Artificial Sequence
  Description of Artificial Sequence: Synthetic peptide
GFTFSDYG

SEQ ID NO: 474 - protein, 8 aa, Artificial Sequence
  Description of Artificial Sequence: Synthetic peptide
GFTFSDYG

SEQ ID NO: 475 - protein, 8 aa, Artificial Sequence
  Description of Artificial Sequence: Synthetic peptide
GFTFSDYG

SEQ ID NO: 476 - protein, 8 aa, Artificial Sequence
  Description of Artificial Sequence: Synthetic peptide
GFTFSDYG

SEQ ID NO: 477 - protein, 8 aa, Artificial Sequence
  Description of Artificial Sequence: Synthetic peptide
GFTFSDYG

SEQ ID NO: 478 - protein, 8 aa, Artificial Sequence
  Description of Artificial Sequence: Synthetic peptide
GFTFSDYG

SEQ ID NO: 479 - protein, 8 aa, Artificial Sequence
  Description of Artificial Sequence: Synthetic peptide
GFTFSDYG

SEQ ID NO: 480 - protein, 8 aa, Artificial Sequence
  Description of Artificial Sequence: Synthetic peptide
GFTFSDYG

SEQ ID NO: 481 - protein, 8 aa, Artificial Sequence
  Description of Artificial Sequence: Synthetic peptide
GFTFSDYG

SEQ ID NO: 482 - protein, 8 aa, Artificial Sequence
  Description of Artificial Sequence: Synthetic peptide
GFTFSDYG

SEQ ID NO: 483 - protein, 8 aa, Artificial Sequence
  Description of Artificial Sequence: Synthetic peptide
GFTFSDYG

SEQ ID NO: 484 - protein, 8 aa, Artificial Sequence
  Description of Artificial Sequence: Synthetic peptide
GFTFSDYG

SEQ ID NO: 485 - protein, 8 aa, Artificial Sequence
  Description of Artificial Sequence: Synthetic peptide
GFTFSDYG

SEQ ID NO: 486 - protein, 8 aa, Artificial Sequence
  Description of Artificial Sequence: Synthetic peptide
GFTFSDYG

SEQ ID NO: 487 - protein, 8 aa, Artificial Sequence
  Description of Artificial Sequence: Synthetic peptide
GFTFSDYG

SEQ ID NO: 488 - protein, 8 aa, Artificial Sequence
  Description of Artificial Sequence: Synthetic peptide
GFTFSDYG

SEQ ID NO: 489 - protein, 8 aa, Artificial Sequence
  Description of Artificial Sequence: Synthetic peptide
GFTFSDYG

SEQ ID NO: 490 - protein, 8 aa, Artificial Sequence
  Description of Artificial Sequence: Synthetic peptide
GFTFSDYG

SEQ ID NO: 491 - protein, 8 aa, Artificial Sequence
  Description of Artificial Sequence: Synthetic peptide
GFTFSDYG

SEQ ID NO: 492 - protein, 8 aa, Artificial Sequence
  Description of Artificial Sequence: Synthetic peptide
GFTFSDYG

SEQ ID NO: 493 - protein, 8 aa, Artificial Sequence
  Description of Artificial Sequence: Synthetic peptide
GFTFSDYG

SEQ ID NO: 494 - protein, 8 aa, Artificial Sequence
  Description of Artificial Sequence: Synthetic peptide
GFTFSDYG

SEQ ID NO: 495 - protein, 8 aa, Artificial Sequence
  Description of Artificial Sequence: Synthetic peptide
GFTFSDYG

SEQ ID NO: 496 - protein, 8 aa, Artificial Sequence
  Description of Artificial Sequence: Synthetic peptide
GFTFSDYG

SEQ ID NO: 497 - protein, 8 aa, Artificial Sequence
  Description of Artificial Sequence: Synthetic peptide
GFTFSDYG

SEQ ID NO: 498 - protein, 8 aa, Artificial Sequence
  Description of Artificial Sequence: Synthetic peptide
GFTFSDYG

SEQ ID NO: 499 - protein, 8 aa, Artificial Sequence
  Description of Artificial Sequence: Synthetic peptide
GFTFSDYG

SEQ ID NO: 500 - protein, 8 aa, Artificial Sequence
  Description of Artificial Sequence: Synthetic peptide
GFTFSDYG

SEQ ID NO: 501 - protein, 8 aa, Artificial Sequence
  Description of Artificial Sequence: Synthetic peptide
GFTFSDYG

SEQ ID NO: 502 - protein, 8 aa, Artificial Sequence
  Description of Artificial Sequence: Synthetic peptide
GFTFSDYG

SEQ ID NO: 503 - protein, 8 aa, Artificial Sequence
  Description of Artificial Sequence: Synthetic peptide
GFTFSDYG

SEQ ID NO: 504 - protein, 8 aa, Artificial Sequence
  Description of Artificial Sequence: Synthetic peptide
GFTFSDYG

SEQ ID NO: 505 - protein, 8 aa, Artificial Sequence
  Description of Artificial Sequence: Synthetic peptide
GFTFSDYG

SEQ ID NO: 506 - protein, 8 aa, Artificial Sequence
  Description of Artificial Sequence: Synthetic peptide
GFTFSDYG

SEQ ID NO: 507 - protein, 8 aa, Artificial Sequence
  Description of Artificial Sequence: Synthetic peptide
GFTFSDYG

SEQ ID NO: 508 - protein, 8 aa, Artificial Sequence
  Description of Artificial Sequence: Synthetic peptide
GFTFSDYG

SEQ ID NO: 509 - protein, 8 aa, Artificial Sequence
  Description of Artificial Sequence: Synthetic peptide
GFTFSDYG

SEQ ID NO: 510 - protein, 8 aa, Artificial Sequence
  Description of Artificial Sequence: Synthetic peptide
GFTFSDYG

SEQ ID NO: 511 - protein, 8 aa, Artificial Sequence
  Description of Artificial Sequence: Synthetic peptide
GFTFSDYG

SEQ ID NO: 512 - protein, 8 aa, Artificial Sequence
  Description of Artificial Sequence: Synthetic peptide
GFTFSDYG

SEQ ID NO: 513 - protein, 8 aa, Artificial Sequence
  Description of Artificial Sequence: Synthetic peptide
GFTFSDYG

SEQ ID NO: 514 - protein, 8 aa, Artificial Sequence
  Description of Artificial Sequence: Synthetic peptide
GFTFSDYG

SEQ ID NO: 515 - protein, 8 aa, Artificial Sequence
  Description of Artificial Sequence: Synthetic peptide
GFTFSDYG

SEQ ID NO: 516 - protein, 8 aa, Artificial Sequence
  Description of Artificial Sequence: Synthetic peptide
GFTFSDYG

SEQ ID NO: 517 - protein, 8 aa, Artificial Sequence
  Description of Artificial Sequence: Synthetic peptide
GFTFSDYG

SEQ ID NO: 518 - protein, 8 aa, Artificial Sequence
  Description of Artificial Sequence: Synthetic peptide
GFTFSDYG

SEQ ID NO: 519 - protein, 8 aa, Artificial Sequence
  Description of Artificial Sequence: Synthetic peptide
GFTFSDYG

SEQ ID NO: 520 - protein, 8 aa, Artificial Sequence
  Description of Artificial Sequence: Synthetic peptide
GFTFSDYG

SEQ ID NO: 521 - protein, 8 aa, Artificial Sequence
  Description of Artificial Sequence: Synthetic peptide
GFTFSDYG

SEQ ID NO: 522 - protein, 8 aa, Artificial Sequence
  Description of Artificial Sequence: Synthetic peptide
GFTFSDYG

SEQ ID NO: 523 - protein, 8 aa, Artificial Sequence
  Description of Artificial Sequence: Synthetic peptide
GFTFSDYG

SEQ ID NO: 524 - protein, 8 aa, Artificial Sequence
  Description of Artificial Sequence: Synthetic peptide
GFTFSDYG

SEQ ID NO: 525 - protein, 8 aa, Artificial Sequence
  Description of Artificial Sequence: Synthetic peptide
GFTFSDYG

SEQ ID NO: 526 - protein, 8 aa, Artificial Sequence
  Description of Artificial Sequence: Synthetic peptide
GFTFSDYG

SEQ ID NO: 527 - protein, 8 aa, Artificial Sequence
  Description of Artificial Sequence: Synthetic peptide
GFTFSDYG

SEQ ID NO: 528 - protein, 8 aa, Artificial Sequence
  Description of Artificial Sequence: Synthetic peptide
GFTFSDYG

SEQ ID NO: 529 - protein, 8 aa, Artificial Sequence
  Description of Artificial Sequence: Synthetic peptide
GFTFSDYG

SEQ ID NO: 530 - protein, 8 aa, Artificial Sequence
  Description of Artificial Sequence: Synthetic peptide
GFTFSDYG

SEQ ID NO: 531 - protein, 8 aa, Artificial Sequence
  Description of Artificial Sequence: Synthetic peptide
GFTFSDYG

SEQ ID NO: 532 - protein, 8 aa, Artificial Sequence
  Description of Artificial Sequence: Synthetic peptide
GFTFNNYP

SEQ ID NO: 533 - protein, 8 aa, Artificial Sequence
  Description of Artificial Sequence: Synthetic peptide
GFTFNNYA

SEQ ID NO: 534 - protein, 8 aa, Artificial Sequence
  Description of Artificial Sequence: Synthetic peptide
GFSFSDYG

SEQ ID NO: 535 - protein, 8 aa, Artificial Sequence
  Description of Artificial Sequence: Synthetic peptide
GFAFSNYG

SEQ ID NO: 536 - protein, 8 aa, Artificial Sequence
  Description of Artificial Sequence: Synthetic peptide
GFSFSDYG

SEQ ID NO: 537 - protein, 8 aa, Artificial Sequence
  Description of Artificial Sequence: Synthetic peptide
GFTFRDYG

SEQ ID NO: 538 - protein, 8 aa, Artificial Sequence
  Description of Artificial Sequence: Synthetic peptide
GFTFNNYG

SEQ ID NO: 539 - protein, 8 aa, Artificial Sequence
  Description of Artificial Sequence: Synthetic peptide
GFTFSAYS

SEQ ID NO: 540 - protein, 8 aa, Artificial Sequence
  Description of Artificial Sequence: Synthetic peptide
GFTFDNYA

SEQ ID NO: 541 - protein, 8 aa, Artificial Sequence
  Description of Artificial Sequence: Synthetic peptide
GFPFSSYA

SEQ ID NO: 542 - protein, 8 aa, Artificial Sequence
  Description of Artificial Sequence: Synthetic peptide
GFTFRDYA

SEQ ID NO: 543 - protein, 8 aa, Artificial Sequence
  Description of Artificial Sequence: Synthetic peptide
GFTFNNYP

SEQ ID NO: 544 - protein, 8 aa, Artificial Sequence
  Description of Artificial Sequence: Synthetic peptide
GLTFSNYA

SEQ ID NO: 545 - protein, 8 aa, Artificial Sequence
  Description of Artificial Sequence: Synthetic peptide
GFTFGSYA

SEQ ID NO: 546 - protein, 8 aa, Artificial Sequence
  Description of Artificial Sequence: Synthetic peptide
GFTFSSYG

SEQ ID NO: 547 - protein, 8 aa, Artificial Sequence
  Description of Artificial Sequence: Synthetic peptide
GFNFNNYG

SEQ ID NO: 548 - protein, 8 aa, Artificial Sequence
  Description of Artificial Sequence: Synthetic peptide
GFTSSSYA

SEQ ID NO: 549 - protein, 8 aa, Artificial Sequence
  Description of Artificial Sequence: Synthetic peptide
GFTFSDYP

SEQ ID NO: 550 - protein, 8 aa, Artificial Sequence
  Description of Artificial Sequence: Synthetic peptide
GFTFGNYG

SEQ ID NO: 551 - protein, 8 aa, Artificial Sequence
  Description of Artificial Sequence: Synthetic peptide
GFTFNNYA

SEQ ID NO: 552 - protein, 8 aa, Artificial Sequence
  Description of Artificial Sequence: Synthetic peptide
GFSFRSYG

SEQ ID NO: 553 - protein, 8 aa, Artificial Sequence
  Description of Artificial Sequence: Synthetic peptide
GFSFSNYA

SEQ ID NO: 554 - protein, 8 aa, Artificial Sequence
  Description of Artificial Sequence: Synthetic peptide
GFAFSSYA

SEQ ID NO: 555 - protein, 8 aa, Artificial Sequence
  Description of Artificial Sequence: Synthetic peptide
GFTFNNYP

SEQ ID NO: 556 - protein, 8 aa, Artificial Sequence
  Description of Artificial Sequence: Synthetic peptide
GFTFGNYA

SEQ ID NO: 557 - protein, 8 aa, Artificial Sequence
  Description of Artificial Sequence: Synthetic peptide
GFAFSNYG

SEQ ID NO: 558 - protein, 8 aa, Artificial Sequence
  Description of Artificial Sequence: Synthetic peptide
GFTFSNYA

SEQ ID NO: 559 - protein, 8 aa, Artificial Sequence
  Description of Artificial Sequence: Synthetic peptide
GFSFGSYA

SEQ ID NO: 560 - protein, 8 aa, Artificial Sequence
  Description of Artificial Sequence: Synthetic peptide
GFTFSSYP

SEQ ID NO: 561 - protein, 8 aa, Artificial Sequence
  Description of Artificial Sequence: Synthetic peptide
GFSFSNYA

SEQ ID NO: 562 - protein, 8 aa, Artificial Sequence
  Description of Artificial Sequence: Synthetic peptide
GFSFSSYG

SEQ ID NO: 563 - protein, 8 aa, Artificial Sequence
  Description of Artificial Sequence: Synthetic peptide
GFSFSNYA

SEQ ID NO: 564 - protein, 8 aa, Artificial Sequence
  Description of Artificial Sequence: Synthetic peptide
GFTFSDYG

SEQ ID NO: 565 - protein, 8 aa, Artificial Sequence
  Description of Artificial Sequence: Synthetic peptide
GFTFSDFA

SEQ ID NO: 566 - protein, 8 aa, Artificial Sequence
  Description of Artificial Sequence: Synthetic peptide
GFTFSDYP

SEQ ID NO: 567 - protein, 8 aa, Artificial Sequence
  Description of Artificial Sequence: Synthetic peptide
GFTFRDYA

SEQ ID NO: 568 - protein, 8 aa, Artificial Sequence
  Description of Artificial Sequence: Synthetic peptide
GFTFNRYG

SEQ ID NO: 569 - protein, 8 aa, Artificial Sequence
  Description of Artificial Sequence: Synthetic peptide
GFPFSSYG

SEQ ID NO: 570 - protein, 8 aa, Artificial Sequence
  Description of Artificial Sequence: Synthetic peptide
GFSFGSYA

SEQ ID NO: 571 - protein, 8 aa, Artificial Sequence
  Description of Artificial Sequence: Synthetic peptide
GFTFSNYD

SEQ ID NO: 572 - protein, 8 aa, Artificial Sequence
  Description of Artificial Sequence: Synthetic peptide
GFSFRTYG

SEQ ID NO: 573 - protein, 8 aa, Artificial Sequence
  Description of Artificial Sequence: Synthetic peptide
GFTFSTYG

SEQ ID NO: 574 - protein, 8 aa, Artificial Sequence
  Description of Artificial Sequence: Synthetic peptide
GFSFSDYA

SEQ ID NO: 575 - protein, 8 aa, Artificial Sequence
  Description of Artificial Sequence: Synthetic peptide
GFTFSNYA

SEQ ID NO: 576 - protein, 8 aa, Artificial Sequence
  Description of Artificial Sequence: Synthetic peptide
GFTFSNYD

SEQ ID NO: 577 - protein, 8 aa, Artificial Sequence
  Description of Artificial Sequence: Synthetic peptide
GFSFSNYA

SEQ ID NO: 578 - protein, 8 aa, Artificial Sequence
  Description of Artificial Sequence: Synthetic peptide
GFTFSDYP

SEQ ID NO: 579 - protein, 8 aa, Artificial Sequence
  Description of Artificial Sequence: Synthetic peptide
GFPFSSYA

SEQ ID NO: 580 - protein, 8 aa, Artificial Sequence
  Description of Artificial Sequence: Synthetic peptide
GFAFSSYA

SEQ ID NO: 581 - protein, 8 aa, Artificial Sequence
  Description of Artificial Sequence: Synthetic peptide
GFSFSNYA

SEQ ID NO: 582 - protein, 8 aa, Artificial Sequence
  Description of Artificial Sequence: Synthetic peptide
GFTFSDYP

SEQ ID NO: 583 - protein, 8 aa, Artificial Sequence
  Description of Artificial Sequence: Synthetic peptide
GFSFSNYG

SEQ ID NO: 584 - protein, 8 aa, Artificial Sequence
  Description of Artificial Sequence: Synthetic peptide
GFSFRNYG

SEQ ID NO: 585 - protein, 8 aa, Artificial Sequence
  Description of Artificial Sequence: Synthetic peptide
GFTFNDYG

SEQ ID NO: 586 - protein, 8 aa, Artificial Sequence
  Description of Artificial Sequence: Synthetic peptide
GFTFGNYA

SEQ ID NO: 587 - protein, 8 aa, Artificial Sequence
  Description of Artificial Sequence: Synthetic peptide
GFTFTNYG

SEQ ID NO: 588 - protein, 8 aa, Artificial Sequence
  Description of Artificial Sequence: Synthetic peptide
GFSFSNYG

SEQ ID NO: 589 - protein, 8 aa, Artificial Sequence
  Description of Artificial Sequence: Synthetic peptide
GFTFSDYP

SEQ ID NO: 590 - protein, 8 aa, Artificial Sequence
  Description of Artificial Sequence: Synthetic peptide
GFSFSNYA

SEQ ID NO: 591 - protein, 8 aa, Artificial Sequence
  Description of Artificial Sequence: Synthetic peptide
GFPFSNYA

SEQ ID NO: 592 - protein, 8 aa, Artificial Sequence
  Description of Artificial Sequence: Synthetic peptide
GFSFSDYG

SEQ ID NO: 593 - protein, 8 aa, Artificial Sequence
  Description of Artificial Sequence: Synthetic peptide
GFTFGSYG

SEQ ID NO: 594 - protein, 8 aa, Artificial Sequence
  Description of Artificial Sequence: Synthetic peptide
GFTFNDYG

SEQ ID NO: 595 - protein, 8 aa, Artificial Sequence
  Description of Artificial Sequence: Synthetic peptide
GFTFRDYG

SEQ ID NO: 596 - protein, 8 aa, Artificial Sequence
  Description of Artificial Sequence: Synthetic peptide
GFTFGNYG

SEQ ID NO: 597 - protein, 8 aa, Artificial Sequence
  Description of Artificial Sequence: Synthetic peptide
GFTFSGYA

SEQ ID NO: 598 - protein, 8 aa, Artificial Sequence
  Description of Artificial Sequence: Synthetic peptide
GFTFSNYA

SEQ ID NO: 599 - protein, 8 aa, Artificial Sequence
  Description of Artificial Sequence: Synthetic peptide
GFNFNNYG

SEQ ID NO: 600 - protein, 8 aa, Artificial Sequence
  Description of Artificial Sequence: Synthetic peptide
GFTFSDYP

SEQ ID NO: 601 - protein, 8 aa, Artificial Sequence
  Description of Artificial Sequence: Synthetic peptide
GFTFNNYP

SEQ ID NO: 602 - protein, 8 aa, Artificial Sequence
  Description of Artificial Sequence: Synthetic peptide
GFTFSDYA

SEQ ID NO: 603 - protein, 8 aa, Artificial Sequence
  Description of Artificial Sequence: Synthetic peptide
GFAFSNYG

SEQ ID NO: 604 - protein, 8 aa, Artificial Sequence
  Description of Artificial Sequence: Synthetic peptide
GFTFNRYG

SEQ ID NO: 605 - protein, 8 aa, Artificial Sequence
  Description of Artificial Sequence: Synthetic peptide
GFIFSNYA

SEQ ID NO: 606 - protein, 8 aa, Artificial Sequence
  Description of Artificial Sequence: Synthetic peptide
GFNFNNYG

SEQ ID NO: 607 - protein, 8 aa, Artificial Sequence
  Description of Artificial Sequence: Synthetic peptide
GFTFGSYG

SEQ ID NO: 608 - protein, 8 aa, Artificial Sequence
  Description of Artificial Sequence: Synthetic peptide
GFTFGSYA

SEQ ID NO: 609 - protein, 8 aa, Artificial Sequence
  Description of Artificial Sequence: Synthetic peptide
GFTFSNYD

SEQ ID NO: 610 - protein, 8 aa, Artificial Sequence
  Description of Artificial Sequence: Synthetic peptide
GFTFKNYG

SEQ ID NO: 611 - protein, 8 aa, Artificial Sequence
  Description of Artificial Sequence: Synthetic peptide
GFSFSDYA

SEQ ID NO: 612 - protein, 8 aa, Artificial Sequence
  Description of Artificial Sequence: Synthetic peptide
GFSFSDYG

SEQ ID NO: 613 - protein, 8 aa, Artificial Sequence
  Description of Artificial Sequence: Synthetic peptide
GFTFGSYG

SEQ ID NO: 614 - protein, 8 aa, Artificial Sequence
  Description of Artificial Sequence: Synthetic peptide
GFTLSNYA

SEQ ID NO: 615 - protein, 8 aa, Artificial Sequence
  Description of Artificial Sequence: Synthetic peptide
GFTFSNFA

SEQ ID NO: 616 - protein, 8 aa, Artificial Sequence
  Description of Artificial Sequence: Synthetic peptide
GFTFRNFG

SEQ ID NO: 617 - protein, 8 aa, Artificial Sequence
  Description of Artificial Sequence: Synthetic peptide
GFTFGSHG

SEQ ID NO: 618 - protein, 8 aa, Artificial Sequence
  Description of Artificial Sequence: Synthetic peptide
GFNFNNYG

SEQ ID NO: 619 - protein, 8 aa, Artificial Sequence
  Description of Artificial Sequence: Synthetic peptide
GFTFGSYG

SEQ ID NO: 620 - protein, 8 aa, Artificial Sequence
  Description of Artificial Sequence: Synthetic peptide
ISYDESNK

SEQ ID NO: 621 - protein, 8 aa, Artificial Sequence
  Description of Artificial Sequence: Synthetic peptide
ISYDRSNE

SEQ ID NO: 622 - protein, 8 aa, Artificial Sequence
  Description of Artificial Sequence: Synthetic peptide
ISYDETNK

SEQ ID NO: 623 - protein, 8 aa, Artificial Sequence
  Description of Artificial Sequence: Synthetic peptide
ISYDESNK

SEQ ID NO: 624 - protein, 8 aa, Artificial Sequence
  Description of Artificial Sequence: Synthetic peptide
ISHDRSNK

SEQ ID NO: 625 - protein, 8 aa, Artificial Sequence
  Description of Artificial Sequence: Synthetic peptide
ISYDETNK

SEQ ID NO: 626 - protein, 8 aa, Artificial Sequence
  Description of Artificial Sequence: Synthetic peptide
ISYGGSNK

SEQ ID NO: 627 - protein, 8 aa, Artificial Sequence
  Description of Artificial Sequence: Synthetic peptide
ISHDRSNK

SEQ ID NO: 628 - protein, 8 aa, Artificial Sequence
  Description of Artificial Sequence: Synthetic peptide
ISYDRSNE

SEQ ID NO: 629 - protein, 8 aa, Artificial Sequence
  Description of Artificial Sequence: Synthetic peptide
ISSDENNK

SEQ ID NO: 630 - protein, 8 aa, Artificial Sequence
  Description of Artificial Sequence: Synthetic peptide
ISDEGSNK

SEQ ID NO: 631 - protein, 8 aa, Artificial Sequence
  Description of Artificial Sequence: Synthetic peptide
ISSDENNK

SEQ ID NO: 632 - protein, 8 aa, Artificial Sequence
  Description of Artificial Sequence: Synthetic peptide
TSYDESNK

SEQ ID NO: 633 - protein, 8 aa, Artificial Sequence
  Description of Artificial Sequence: Synthetic peptide
ISSDASDK

SEQ ID NO: 634 - protein, 8 aa, Artificial Sequence
  Description of Artificial Sequence: Synthetic peptide
TSYDESNK

SEQ ID NO: 635 - protein, 8 aa, Artificial Sequence
  Description of Artificial Sequence: Synthetic peptide
ISYEGSNK

SEQ ID NO: 636 - protein, 8 aa, Artificial Sequence
  Description of Artificial Sequence: Synthetic peptide
ISSDASDK

SEQ ID NO: 637 - protein, 8 aa, Artificial Sequence
  Description of Artificial Sequence: Synthetic peptide
ISYDESNE

SEQ ID NO: 638 - protein, 8 aa, Artificial Sequence
  Description of Artificial Sequence: Synthetic peptide
ISYDRSNE

SEQ ID NO: 639 - protein, 8 aa, Artificial Sequence
  Description of Artificial Sequence: Synthetic peptide
ISDEGSNK

SEQ ID NO: 640 - protein, 8 aa, Artificial Sequence
  Description of Artificial Sequence: Synthetic peptide
ISSDENNK

SEQ ID NO: 641 - protein, 8 aa, Artificial Sequence
  Description of Artificial Sequence: Synthetic peptide
ISYDASNK

SEQ ID NO: 642 - protein, 8 aa, Artificial Sequence
  Description of Artificial Sequence: Synthetic peptide
ISSDASDK

SEQ ID NO: 643 - protein, 8 aa, Artificial Sequence
  Description of Artificial Sequence: Synthetic peptide
ISHDRSNK

SEQ ID NO: 644 - protein, 8 aa, Artificial Sequence
  Description of Artificial Sequence: Synthetic peptide
ISYDANNK

SEQ ID NO: 645 - protein, 8 aa, Artificial Sequence
  Description of Artificial Sequence: Synthetic peptide
ISYEGSNQ

SEQ ID NO: 646 - protein, 8 aa, Artificial Sequence
  Description of Artificial Sequence: Synthetic peptide
TSYDESNK

SEQ ID NO: 647 - protein, 8 aa, Artificial Sequence
  Description of Artificial Sequence: Synthetic peptide
ISYDATNK

SEQ ID NO: 648 - protein, 8 aa, Artificial Sequence
  Description of Artificial Sequence: Synthetic peptide
ISYHGSNK

SEQ ID NO: 649 - protein, 8 aa, Artificial Sequence
  Description of Artificial Sequence: Synthetic peptide
ISYDASNK

SEQ ID NO: 650 - protein, 8 aa, Artificial Sequence
  Description of Artificial Sequence: Synthetic peptide
ISSDASDK

SEQ ID NO: 651 - protein, 8 aa, Artificial Sequence
  Description of Artificial Sequence: Synthetic peptide
TSYDESNK

SEQ ID NO: 652 - protein, 8 aa, Artificial Sequence
  Description of Artificial Sequence: Synthetic peptide
ISSDASNK

SEQ ID NO: 653 - protein, 8 aa, Artificial Sequence
  Description of Artificial Sequence: Synthetic peptide
ISYDANNK

SEQ ID NO: 654 - protein, 8 aa, Artificial Sequence
  Description of Artificial Sequence: Synthetic peptide
ISHDRSNK

SEQ ID NO: 655 - protein, 8 aa, Artificial Sequence
  Description of Artificial Sequence: Synthetic peptide
IRYGGSNK

SEQ ID NO: 656 - protein, 8 aa, Artificial Sequence
  Description of Artificial Sequence: Synthetic peptide
ISYDATNK

SEQ ID NO: 657 - protein, 8 aa, Artificial Sequence
  Description of Artificial Sequence: Synthetic peptide
ISDEGSNK

SEQ ID NO: 658 - protein, 8 aa, Artificial Sequence
  Description of Artificial Sequence: Synthetic peptide
ISYEGSNQ

SEQ ID NO: 659 - protein, 8 aa, Artificial Sequence
  Description of Artificial Sequence: Synthetic peptide
ISDEGSNK

SEQ ID NO: 660 - protein, 8 aa, Artificial Sequence
  Description of Artificial Sequence: Synthetic peptide
ISDEGSNK

SEQ ID NO: 661 - protein, 8 aa, Artificial Sequence
  Description of Artificial Sequence: Synthetic peptide
TSYDESNK

SEQ ID NO: 662 - protein, 8 aa, Artificial Sequence
  Description of Artificial Sequence: Synthetic peptide
ISSDASHK

SEQ ID NO: 663 - protein, 8 aa, Artificial Sequence
  Description of Artificial Sequence: Synthetic peptide
ISYDETNK

SEQ ID NO: 664 - protein, 8 aa, Artificial Sequence
  Description of Artificial Sequence: Synthetic peptide
ISDEGSNK

SEQ ID NO: 665 - protein, 8 aa, Artificial Sequence
  Description of Artificial Sequence: Synthetic peptide
ISYGGSNK

SEQ ID NO: 666 - protein, 8 aa, Artificial Sequence
  Description of Artificial Sequence: Synthetic peptide
ISSDASHK

SEQ ID NO: 667 - protein, 8 aa, Artificial Sequence
  Description of Artificial Sequence: Synthetic peptide
ISYDESNK

SEQ ID NO: 668 - protein, 8 aa, Artificial Sequence
  Description of Artificial Sequence: Synthetic peptide
ISSDASDK

SEQ ID NO: 669 - protein, 8 aa, Artificial Sequence
  Description of Artificial Sequence: Synthetic peptide
ISYGGSNK

SEQ ID NO: 670 - protein, 8 aa, Artificial Sequence
  Description of Artificial Sequence: Synthetic peptide
TSYDESNK

SEQ ID NO: 671 - protein, 8 aa, Artificial Sequence
  Description of Artificial Sequence: Synthetic peptide
ISHDRSNK

SEQ ID NO: 672 - protein, 8 aa, Artificial Sequence
  Description of Artificial Sequence: Synthetic peptide
ISHDRSNK

SEQ ID NO: 673 - protein, 8 aa, Artificial Sequence
  Description of Artificial Sequence: Synthetic peptide
ISSDASDK

SEQ ID NO: 674 - protein, 8 aa, Artificial Sequence
  Description of Artificial Sequence: Synthetic peptide
ISHDRSNK

SEQ ID NO: 675 - protein, 8 aa, Artificial Sequence
  Description of Artificial Sequence: Synthetic peptide
ISSDASDK

SEQ ID NO: 676 - protein, 8 aa, Artificial Sequence
  Description of Artificial Sequence: Synthetic peptide
ISSDASDK

SEQ ID NO: 677 - protein, 8 aa, Artificial Sequence
  Description of Artificial Sequence: Synthetic peptide
ISYDATNK

SEQ ID NO: 678 - protein, 8 aa, Artificial Sequence
  Description of Artificial Sequence: Synthetic peptide
ISSDASHK

SEQ ID NO: 679 - protein, 8 aa, Artificial Sequence
  Description of Artificial Sequence: Synthetic peptide
ISSDASDK

SEQ ID NO: 680 - protein, 8 aa, Artificial Sequence
  Description of Artificial Sequence: Synthetic peptide
ISSDASDK

SEQ ID NO: 681 - protein, 8 aa, Artificial Sequence
  Description of Artificial Sequence: Synthetic peptide
ISYDAGNK

SEQ ID NO: 682 - protein, 8 aa, Artificial Sequence
  Description of Artificial Sequence: Synthetic peptide
TSYEESNK

SEQ ID NO: 683 - protein, 8 aa, Artificial Sequence
  Description of Artificial Sequence: Synthetic peptide
ISHDRSNK

SEQ ID NO: 684 - protein, 8 aa, Artificial Sequence
  Description of Artificial Sequence: Synthetic peptide
ISSDASDK

SEQ ID NO: 685 - protein, 8 aa, Artificial Sequence
  Description of Artificial Sequence: Synthetic peptide
ISSDENNK

SEQ ID NO: 686 - protein, 8 aa, Artificial Sequence
  Description of Artificial Sequence: Synthetic peptide
ISYGGSNK

SEQ ID NO: 687 - protein, 8 aa, Artificial Sequence
  Description of Artificial Sequence: Synthetic peptide
ISSDASNK

SEQ ID NO: 688 - protein, 8 aa, Artificial Sequence
  Description of Artificial Sequence: Synthetic peptide
IRYDESNK

SEQ ID NO: 689 - protein, 8 aa, Artificial Sequence
  Description of Artificial Sequence: Synthetic peptide
ISSDASNK

SEQ ID NO: 690 - protein, 8 aa, Artificial Sequence
  Description of Artificial Sequence: Synthetic peptide
ISSDASDK

SEQ ID NO: 691 - protein, 8 aa, Artificial Sequence
  Description of Artificial Sequence: Synthetic peptide
ISDEGSNK

SEQ ID NO: 692 - protein, 8 aa, Artificial Sequence
  Description of Artificial Sequence: Synthetic peptide
ISHDRSNK

SEQ ID NO: 693 - protein, 8 aa, Artificial Sequence
  Description of Artificial Sequence: Synthetic peptide
ISYDETNK

SEQ ID NO: 694 - protein, 8 aa, Artificial Sequence
  Description of Artificial Sequence: Synthetic peptide
ISYDESNK

SEQ ID NO: 695 - protein, 8 aa, Artificial Sequence
  Description of Artificial Sequence: Synthetic peptide
ISDEGSNK

SEQ ID NO: 696 - protein, 8 aa, Artificial Sequence
  Description of Artificial Sequence: Synthetic peptide
ISYDESNK

SEQ ID NO: 697 - protein, 8 aa, Artificial Sequence
  Description of Artificial Sequence: Synthetic peptide
ISYDAGNK

SEQ ID NO: 698 - protein, 8 aa, Artificial Sequence
  Description of Artificial Sequence: Synthetic peptide
ISDEGSNK

SEQ ID NO: 699 - protein, 8 aa, Artificial Sequence
  Description of Artificial Sequence: Synthetic peptide
ISYDENNK

SEQ ID NO: 700 - protein, 8 aa, Artificial Sequence
  Description of Artificial Sequence: Synthetic peptide
TSYDESNK

SEQ ID NO: 701 - protein, 8 aa, Artificial Sequence
  Description of Artificial Sequence: Synthetic peptide
ISYDAGNK

SEQ ID NO: 702 - protein, 8 aa, Artificial Sequence
  Description of Artificial Sequence: Synthetic peptide
ISNDENNK

SEQ ID NO: 703 - protein, 8 aa, Artificial Sequence
  Description of Artificial Sequence: Synthetic peptide
TSYDESNK

SEQ ID NO: 704 - protein, 8 aa, Artificial Sequence
  Description of Artificial Sequence: Synthetic peptide
ISDEGSNK

SEQ ID NO: 705 - protein, 8 aa, Artificial Sequence
  Description of Artificial Sequence: Synthetic peptide
ISYDATNK

SEQ ID NO: 706 - protein, 8 aa, Artificial Sequence
  Description of Artificial Sequence: Synthetic peptide
ISDEGSNK

SEQ ID NO: 707 - protein, 8 aa, Artificial Sequence
  Description of Artificial Sequence: Synthetic peptide
ISSDASNK

SEQ ID NO: 708 - protein, 8 aa, Artificial Sequence
  Description of Artificial Sequence: Synthetic peptide
ISDEGSNK

SEQ ID NO: 709 - protein, 8 aa, Artificial Sequence
  Description of Artificial Sequence: Synthetic peptide
ISSDASDK

SEQ ID NO: 710 - protein, 8 aa, Artificial Sequence
  Description of Artificial Sequence: Synthetic peptide
ISSDASDK

SEQ ID NO: 711 - protein, 8 aa, Artificial Sequence
  Description of Artificial Sequence: Synthetic peptide
ISYDESNK

SEQ ID NO: 712 - protein, 8 aa, Artificial Sequence
  Description of Artificial Sequence: Synthetic peptide
ISDEGSNK

SEQ ID NO: 713 - protein, 8 aa, Artificial Sequence
  Description of Artificial Sequence: Synthetic peptide
ISYDANNK

SEQ ID NO: 714 - protein, 8 aa, Artificial Sequence
  Description of Artificial Sequence: Synthetic peptide
ISYDESNK

SEQ ID NO: 715 - protein, 8 aa, Artificial Sequence
  Description of Artificial Sequence: Synthetic peptide
ISYEGSNK

SEQ ID NO: 716 - protein, 8 aa, Artificial Sequence
  Description of Artificial Sequence: Synthetic peptide
IRYDEINK

SEQ ID NO: 717 - protein, 8 aa, Artificial Sequence
  Description of Artificial Sequence: Synthetic peptide
ISDEGSNK

SEQ ID NO: 718 - protein, 8 aa, Artificial Sequence
  Description of Artificial Sequence: Synthetic peptide
ISYDATNK

SEQ ID NO: 719 - protein, 8 aa, Artificial Sequence
  Description of Artificial Sequence: Synthetic peptide
ISYDAGNK

SEQ ID NO: 720 - protein, 8 aa, Artificial Sequence
  Description of Artificial Sequence: Synthetic peptide
ISYDRSNK

SEQ ID NO: 721 - protein, 8 aa, Artificial Sequence
  Description of Artificial Sequence: Synthetic peptide
ISFDESNK

SEQ ID NO: 722 - protein, 8 aa, Artificial Sequence
  Description of Artificial Sequence: Synthetic peptide
ISHDRSNK

SEQ ID NO: 723 - protein, 8 aa, Artificial Sequence
  Description of Artificial Sequence: Synthetic peptide
TSYDESNK

SEQ ID NO: 724 - protein, 8 aa, Artificial Sequence
  Description of Artificial Sequence: Synthetic peptide
TSYDESNK

SEQ ID NO: 725 - protein, 8 aa, Artificial Sequence
  Description of Artificial Sequence: Synthetic peptide
ISSDASDK

SEQ ID NO: 726 - protein, 8 aa, Artificial Sequence
  Description of Artificial Sequence: Synthetic peptide
ISYDASNK

SEQ ID NO: 727 - protein, 8 aa, Artificial Sequence
  Description of Artificial Sequence: Synthetic peptide
ISDEGSNK

SEQ ID NO: 728 - protein, 8 aa, Artificial Sequence
  Description of Artificial Sequence: Synthetic peptide
ISYDESNK

SEQ ID NO: 729 - protein, 8 aa, Artificial Sequence
  Description of Artificial Sequence: Synthetic peptide
ISYDASNK

SEQ ID NO: 730 - protein, 8 aa, Artificial Sequence
  Description of Artificial Sequence: Synthetic peptide
ISYAGSNE

SEQ ID NO: 731 - protein, 8 aa, Artificial Sequence
  Description of Artificial Sequence: Synthetic peptide
ISSDASNK

SEQ ID NO: 732 - protein, 8 aa, Artificial Sequence
  Description of Artificial Sequence: Synthetic peptide
TSYDESNK

SEQ ID NO: 733 - protein, 8 aa, Artificial Sequence
  Description of Artificial Sequence: Synthetic peptide
ISYDENNK

SEQ ID NO: 734 - protein, 8 aa, Artificial Sequence
  Description of Artificial Sequence: Synthetic peptide
IWSDASQK

SEQ ID NO: 735 - protein, 8 aa, Artificial Sequence
  Description of Artificial Sequence: Synthetic peptide
ISSDASDK

SEQ ID NO: 736 - protein, 8 aa, Artificial Sequence
  Description of Artificial Sequence: Synthetic peptide
ISYDASNK

SEQ ID NO: 737 - protein, 8 aa, Artificial Sequence
  Description of Artificial Sequence: Synthetic peptide
ISYDASNK

SEQ ID NO: 738 - protein, 8 aa, Artificial Sequence
  Description of Artificial Sequence: Synthetic peptide
TSYDESNK

SEQ ID NO: 739 - protein, 8 aa, Artificial Sequence
  Description of Artificial Sequence: Synthetic peptide
ISYEGTNK

SEQ ID NO: 740 - protein, 8 aa, Artificial Sequence
  Description of Artificial Sequence: Synthetic peptide
ISYDESNE

SEQ ID NO: 741 - protein, 8 aa, Artificial Sequence
  Description of Artificial Sequence: Synthetic peptide
ISYGGSNK

SEQ ID NO: 742 - protein, 8 aa, Artificial Sequence
  Description of Artificial Sequence: Synthetic peptide
TSYDESNK

SEQ ID NO: 743 - protein, 8 aa, Artificial Sequence
  Description of Artificial Sequence: Synthetic peptide
ISYDESNK

SEQ ID NO: 744 - protein, 8 aa, Artificial Sequence
  Description of Artificial Sequence: Synthetic peptide
ISYEGSNK

SEQ ID NO: 745 - protein, 8 aa, Artificial Sequence
  Description of Artificial Sequence: Synthetic peptide
ISDEGSNK

SEQ ID NO: 746 - protein, 8 aa, Artificial Sequence
  Description of Artificial Sequence: Synthetic peptide
ISYDATNK

SEQ ID NO: 747 - protein, 8 aa, Artificial Sequence
  Description of Artificial Sequence: Synthetic peptide
ISYDASNK

SEQ ID NO: 748 - protein, 8 aa, Artificial Sequence
  Description of Artificial Sequence: Synthetic peptide
ISYDATNK

SEQ ID NO: 749 - protein, 8 aa, Artificial Sequence
  Description of Artificial Sequence: Synthetic peptide
ISYDASNK

SEQ ID NO: 750 - protein, 8 aa, Artificial Sequence
  Description of Artificial Sequence: Synthetic peptide
ISYAGSNK

SEQ ID NO: 751 - protein, 8 aa, Artificial Sequence
  Description of Artificial Sequence: Synthetic peptide
ISDEGSNK

SEQ ID NO: 752 - protein, 8 aa, Artificial Sequence
  Description of Artificial Sequence: Synthetic peptide
ISYDANNK

SEQ ID NO: 753 - protein, 8 aa, Artificial Sequence
  Description of Artificial Sequence: Synthetic peptide
ISSDASNK

SEQ ID NO: 754 - protein, 8 aa, Artificial Sequence
  Description of Artificial Sequence: Synthetic peptide
ISYDATNK

SEQ ID NO: 755 - protein, 8 aa, Artificial Sequence
  Description of Artificial Sequence: Synthetic peptide
TSYDESKK

SEQ ID NO: 756 - protein, 8 aa, Artificial Sequence
  Description of Artificial Sequence: Synthetic peptide
TSYDESNK

SEQ ID NO: 757 - protein, 8 aa, Artificial Sequence
  Description of Artificial Sequence: Synthetic peptide
ISYAGSNE

SEQ ID NO: 758 - protein, 8 aa, Artificial Sequence
  Description of Artificial Sequence: Synthetic peptide
ISYDANNK

SEQ ID NO: 759 - protein, 8 aa, Artificial Sequence
  Description of Artificial Sequence: Synthetic peptide
ISYDESNK

SEQ ID NO: 760 - protein, 8 aa, Artificial Sequence
  Description of Artificial Sequence: Synthetic peptide
ISFDESNK

SEQ ID NO: 761 - protein, 8 aa, Artificial Sequence
  Description of Artificial Sequence: Synthetic peptide
ISYDRSNE

SEQ ID NO: 762 - protein, 8 aa, Artificial Sequence
  Description of Artificial Sequence: Synthetic peptide
ISSDASNK

SEQ ID NO: 763 - protein, 8 aa, Artificial Sequence
  Description of Artificial Sequence: Synthetic peptide
ISYDESNK

SEQ ID NO: 764 - protein, 8 aa, Artificial Sequence
  Description of Artificial Sequence: Synthetic peptide
ISSDASNK

SEQ ID NO: 765 - protein, 8 aa, Artificial Sequence
  Description of Artificial Sequence: Synthetic peptide
ISSDASNK

SEQ ID NO: 766 - protein, 8 aa, Artificial Sequence
  Description of Artificial Sequence: Synthetic peptide
ISSDASDK

SEQ ID NO: 767 - protein, 8 aa, Artificial Sequence
  Description of Artificial Sequence: Synthetic peptide
ISYGGSNK

SEQ ID NO: 768 - protein, 8 aa, Artificial Sequence
  Description of Artificial Sequence: Synthetic peptide
ISSDASDK

SEQ ID NO: 769 - protein, 8 aa, Artificial Sequence
  Description of Artificial Sequence: Synthetic peptide
ISYDASNK

SEQ ID NO: 770 - protein, 8 aa, Artificial Sequence
  Description of Artificial Sequence: Synthetic peptide
ISSDASNK

SEQ ID NO: 771 - protein, 8 aa, Artificial Sequence
  Description of Artificial Sequence: Synthetic peptide
ISYDANNK

SEQ ID NO: 772 - protein, 8 aa, Artificial Sequence
  Description of Artificial Sequence: Synthetic peptide
ISDEGSNK

SEQ ID NO: 773 - protein, 8 aa, Artificial Sequence
  Description of Artificial Sequence: Synthetic peptide
ISSDENNK

SEQ ID NO: 774 - protein, 8 aa, Artificial Sequence
  Description of Artificial Sequence: Synthetic peptide
ISSDENNK

SEQ ID NO: 775 - protein, 8 aa, Artificial Sequence
  Description of Artificial Sequence: Synthetic peptide
ISSDASHK

SEQ ID NO: 776 - protein, 8 aa, Artificial Sequence
  Description of Artificial Sequence: Synthetic peptide
ISSDENNK

SEQ ID NO: 777 - protein, 8 aa, Artificial Sequence
  Description of Artificial Sequence: Synthetic peptide
ISDEGSNK

SEQ ID NO: 778 - protein, 8 aa, Artificial Sequence
  Description of Artificial Sequence: Synthetic peptide
ISYDESNK

SEQ ID NO: 779 - protein, 8 aa, Artificial Sequence
  Description of Artificial Sequence: Synthetic peptide
ISSDASDK

SEQ ID NO: 780 - protein, 8 aa, Artificial Sequence
  Description of Artificial Sequence: Synthetic peptide
ISYGGSDK

SEQ ID NO: 781 - protein, 8 aa, Artificial Sequence
  Description of Artificial Sequence: Synthetic peptide
IPYDESNK

SEQ ID NO: 782 - protein, 8 aa, Artificial Sequence
  Description of Artificial Sequence: Synthetic peptide
ISDEGSNK

SEQ ID NO: 783 - protein, 8 aa, Artificial Sequence
  Description of Artificial Sequence: Synthetic peptide
ISDEGSNK

SEQ ID NO: 784 - protein, 8 aa, Artificial Sequence
  Description of Artificial Sequence: Synthetic peptide
ISYDASNK

SEQ ID NO: 785 - protein, 8 aa, Artificial Sequence
  Description of Artificial Sequence: Synthetic peptide
ISSDASNK

SEQ ID NO: 786 - protein, 8 aa, Artificial Sequence
  Description of Artificial Sequence: Synthetic peptide
ISSDENNK

SEQ ID NO: 787 - protein, 8 aa, Artificial Sequence
  Description of Artificial Sequence: Synthetic peptide
TSYDESNK

SEQ ID NO: 788 - protein, 8 aa, Artificial Sequence
  Description of Artificial Sequence: Synthetic peptide
ISDEGSNK

SEQ ID NO: 789 - protein, 8 aa, Artificial Sequence
  Description of Artificial Sequence: Synthetic peptide
ISYGGSNK

SEQ ID NO: 790 - protein, 8 aa, Artificial Sequence
  Description of Artificial Sequence: Synthetic peptide
ISDDGSNK

SEQ ID NO: 791 - protein, 8 aa, Artificial Sequence
  Description of Artificial Sequence: Synthetic peptide
ISSDASDK

SEQ ID NO: 792 - protein, 8 aa, Artificial Sequence
  Description of Artificial Sequence: Synthetic peptide
ISSDENNK

SEQ ID NO: 793 - protein, 8 aa, Artificial Sequence
  Description of Artificial Sequence: Synthetic peptide
IPYDESNK

SEQ ID NO: 794 - protein, 8 aa, Artificial Sequence
  Description of Artificial Sequence: Synthetic peptide
ISSDASNK

SEQ ID NO: 795 - protein, 8 aa, Artificial Sequence
  Description of Artificial Sequence: Synthetic peptide
ISSDASNK

SEQ ID NO: 796 - protein, 8 aa, Artificial Sequence
  Description of Artificial Sequence: Synthetic peptide
ISSDENNK

SEQ ID NO: 797 - protein, 8 aa, Artificial Sequence
  Description of Artificial Sequence: Synthetic peptide
ISDEGSNK

SEQ ID NO: 798 - protein, 8 aa, Artificial Sequence
  Description of Artificial Sequence: Synthetic peptide
ISYDASNK

SEQ ID NO: 799 - protein, 41 aa, Artificial Sequence
  Description of Artificial Sequence: Synthetic polypeptide
AKHMSMQEGAVTGEGQAAKEFIAWLVKGRVRADLVGDAFDV

SEQ ID NO: 800 - protein, 41 aa, Artificial Sequence
  Description of Artificial Sequence: Synthetic polypeptide
AKHMSMQEGAVTGDGQAAKEFIAWLVKGRVRADLVGDAFDV

SEQ ID NO: 801 - protein, 41 aa, Artificial Sequence
  Description of Artificial Sequence: Synthetic polypeptide
AKHMSMQEGAVTGEGQAAKEFIAWLVKGIVRADLVGDAFDV

SEQ ID NO: 802 - protein, 41 aa, Artificial Sequence
  Description of Artificial Sequence: Synthetic polypeptide
AKHMSMQEGAVTGEYQAAKEFIAWLVKGRVRADLVGDAFDV

SEQ ID NO: 803 - protein, 41 aa, Artificial Sequence
  Description of Artificial Sequence: Synthetic polypeptide
AKHMSMQEGAVTGEGQAAKDFIAWLVKGRVRADLVGDAFDV

SEQ ID NO: 804 - protein, 41 aa, Artificial Sequence; identical to SEQ ID NO: 801
  Description of Artificial Sequence: Synthetic polypeptide

SEQ ID NO: 805 - protein, 41 aa, Artificial Sequence
  Description of Artificial Sequence: Synthetic polypeptide
AKHMSMQEGAVTGEGQAVKEFIAWLVKGRVRADLVGDAFDV

SEQ ID NO: 806 - protein, 41 aa, Artificial Sequence; identical to SEQ ID NO: 805
  Description of Artificial Sequence: Synthetic polypeptide

SEQ ID NO: 807 - protein, 41 aa, Artificial Sequence
  Description of Artificial Sequence: Synthetic polypeptide
AKHMSMQEGAVTGEGQAIKEFIAWLVKGRVRADLVGDAFDV

SEQ ID NO: 808 - protein, 41 aa, Artificial Sequence
  Description of Artificial Sequence: Synthetic polypeptide
AKHMSMQEGAVTGEMQAAKEFIAWLVKGRVRADLVGDAFDV

SEQ ID NO: 809 - protein, 41 aa, Artificial Sequence
  Description of Artificial Sequence: Synthetic polypeptide
AKHMSMQEGAVTGAGQAAKEFIAWLVKGRVRADLVGDAFDV

SEQ ID NO: 810 - protein, 41 aa, Artificial Sequence
  Description of Artificial Sequence: Synthetic polypeptide
AKHMSMQEGAVTGEFQAAKEFIAWLVKGRVRADLVGDAFDV

SEQ ID NO: 811 - protein, 41 aa, Artificial Sequence; identical to SEQ ID NO: 802
  Description of Artificial Sequence: Synthetic polypeptide

SEQ ID NO: 812 - protein, 41 aa, Artificial Sequence; identical to SEQ ID NO: 802
  Description of Artificial Sequence: Synthetic polypeptide

SEQ ID NO: 813 - protein, 41 aa, Artificial Sequence
  Description of Artificial Sequence: Synthetic polypeptide
AKHMSMQEGAVTGVGQAAKEFIAWLVKGRVRADLVGDAFDV

SEQ ID NO: 814 - protein, 41 aa, Artificial Sequence
  Description of Artificial Sequence: Synthetic polypeptide
AKHMSMQEGAVTGMGQAAKEFIAWLIKGRVRADLVGDAFDV

SEQ ID NO: 815 - protein, 41 aa, Artificial Sequence
  Description of Artificial Sequence: Synthetic polypeptide
AKHMSMQEGAVTGMGQAAKEFIAWLVKGRVRADLVGDAFDV

SEQ ID NO: 816 - protein, 41 aa, Artificial Sequence
  Description of Artificial Sequence: Synthetic polypeptide
AKHMSMQEGAVTGEHQAAKEFIAWLVKGRVRADLVGDAFDV

SEQ ID NO: 817 - protein, 41 aa, Artificial Sequence
  Description of Artificial Sequence: Synthetic polypeptide
AKHMSMQEGAVHGEGQAAKEFIAWLVKGRVRADLVGDAFDV

SEQ ID NO: 818 - protein, 41 aa, Artificial Sequence
  Description of Artificial Sequence: Synthetic polypeptide
AKHMSMQEGAVTGEWQAAKEFIAWLVKGRVRADLVGDAFDV

SEQ ID NO: 819 - protein, 41 aa, Artificial Sequence; identical to SEQ ID NO: 810
  Description of Artificial Sequence: Synthetic polypeptide

SEQ ID NO: 820 - protein, 41 aa, Artificial Sequence; identical to SEQ ID NO: 805
  Description of Artificial Sequence: Synthetic polypeptide

SEQ ID NO: 821 - protein, 41 aa, Artificial Sequence; identical to SEQ ID NO: 818
  Description of Artificial Sequence: Synthetic polypeptide

SEQ ID NO: 822 - protein, 41 aa, Artificial Sequence
  Description of Artificial Sequence: Synthetic polypeptide
AKHMSMQEGAVTGLGQAAKEFIAWLVKGRVRADLVGDAFDV

SEQ ID NO: 823 - protein, 41 aa, Artificial Sequence
  Description of Artificial Sequence: Synthetic polypeptide
AKHMSMQEGAVTGEGQAAKEFIAWLIKGRVRADLVGDAFDV

SEQ ID NO: 824 - protein, 41 aa, Artificial Sequence
  Description of Artificial Sequence: Synthetic polypeptide
AKHMSMQEGAVTGIGQAAKEFIAWLVKGRVRADLVGDAFDV

SEQ ID NO: 825 - protein, 41 aa, Artificial Sequence
  Description of Artificial Sequence: Synthetic polypeptide
AKHMSMQEGAVTGFGQAAKEFIAWLVKGRVRADLVGDAFDV

SEQ ID NO: 826 - protein, 41 aa, Artificial Sequence; identical to SEQ ID NO: 815
  Description of Artificial Sequence: Synthetic polypeptide

SEQ ID NO: 827 - protein, 41 aa, Artificial Sequence; identical to SEQ ID NO: 815
  Description of Artificial Sequence: Synthetic polypeptide

SEQ ID NO: 828 - protein, 41 aa, Artificial Sequence
  Description of Artificial Sequence: Synthetic polypeptide
AKHMSMQEGAVTGYGQAAKEFIAWLVKGRVRADLVGDAFDV

SEQ ID NO: 829 - protein, 41 aa, Artificial Sequence; identical to SEQ ID NO: 810
  Description of Artificial Sequence: Synthetic polypeptide

SEQ ID NO: 830 - protein, 41 aa, Artificial Sequence
  Description of Artificial Sequence: Synthetic polypeptide
AKHMSMQEGAVTGGGQAAKEFIAWLVKGRVRADLVGDAFDV

SEQ ID NO: 831 - protein, 41 aa, Artificial Sequence; identical to SEQ ID NO: 805
  Description of Artificial Sequence: Synthetic polypeptide

SEQ ID NO: 832 - protein, 41 aa, Artificial Sequence; identical to SEQ ID NO: 818
  Description of Artificial Sequence: Synthetic polypeptide

SEQ ID NO: 833 - protein, 41 aa, Artificial Sequence
  Description of Artificial Sequence: Synthetic polypeptide
AKHMSMQEGAVTGPGQAAKEFIAWLVKGRVRADLVGDAFDV

SEQ ID NO: 834 - protein, 41 aa, Artificial Sequence; identical to SEQ ID NO: 799
  Description of Artificial Sequence: Synthetic polypeptide

SEQ ID NO: 835 - protein, 41 aa, Artificial Sequence; identical to SEQ ID NO: 828
  Description of Artificial Sequence: Synthetic polypeptide

SEQ ID NO: 836 - protein, 41 aa, Artificial Sequence; identical to SEQ ID NO: 815
  Description of Artificial Sequence: Synthetic polypeptide

SEQ ID NO: 837 - protein, 41 aa, Artificial Sequence
  Description of Artificial Sequence: Synthetic polypeptide
AKHMSMQEGAVTGWGQAAKEFIAWLVKGRVRADLVGDAFDV

SEQ ID NO: 838 - protein, 41 aa, Artificial Sequence; identical to SEQ ID NO: 822
  Description of Artificial Sequence: Synthetic polypeptide

SEQ ID NO: 839 - protein, 41 aa, Artificial Sequence; identical to SEQ ID NO: 818
  Description of Artificial Sequence: Synthetic polypeptide

SEQ ID NO: 840 - protein, 41 aa, Artificial Sequence; identical to SEQ ID NO: 818
  Description of Artificial Sequence: Synthetic polypeptide

SEQ ID NO: 841 - protein, 41 aa, Artificial Sequence
  Description of Artificial Sequence: Synthetic polypeptide
AKHMSMQEGAVTWEGQAAKEFIAWLVKGRVRADLVGDAFDV

SEQ ID NO: 842 - protein, 41 aa, Artificial Sequence; identical to SEQ ID NO: 825
  Description of Artificial Sequence: Synthetic polypeptide

SEQ ID NO: 843 - protein, 41 aa, Artificial Sequence; identical to SEQ ID NO: 815
  Description of Artificial Sequence: Synthetic polypeptide

SEQ ID NO: 844 - protein, 41 aa, Artificial Sequence
  Description of Artificial Sequence: Synthetic polypeptide
AKHMSMQEGAVTNEGQAAKEFIAWLVKGRVRADLVGDAFDV

SEQ ID NO: 845 - protein, 41 aa, Artificial Sequence; identical to SEQ ID NO: 841
  Description of Artificial Sequence: Synthetic polypeptide

SEQ ID NO: 846 - protein, 41 aa, Artificial Sequence; identical to SEQ ID NO: 818
  Description of Artificial Sequence: Synthetic polypeptide

SEQ ID NO: 847 - protein, 41 aa, Artificial Sequence; identical to SEQ ID NO: 830
  Description of Artificial Sequence: Synthetic polypeptide

SEQ ID NO: 848 - protein, 41 aa, Artificial Sequence; identical to SEQ ID NO: 818
  Description of Artificial Sequence: Synthetic polypeptide

SEQ ID NO: 849 - protein, 41 aa, Artificial Sequence; identical to SEQ ID NO: 818
  Description of Artificial Sequence: Synthetic polypeptide

SEQ ID NO: 850 - protein, 41 aa, Artificial Sequence
  Description of Artificial Sequence: Synthetic polypeptide
AKHMSMQEGAVTGEGQALKEFIAWLVKGRVRADLVGDAFDV

SEQ ID NO: 851 - protein, 41 aa, Artificial Sequence; identical to SEQ ID NO: 803
  Description of Artificial Sequence: Synthetic polypeptide

SEQ ID NO: 852 - protein, 41 aa, Artificial Sequence; identical to SEQ ID NO: 837
  Description of Artificial Sequence: Synthetic polypeptide

SEQ ID NO: 853 - protein, 41 aa, Artificial Sequence; identical to SEQ ID NO: 837
  Description of Artificial Sequence: Synthetic polypeptide

SEQ ID NO: 854 - protein, 41 aa, Artificial Sequence; identical to SEQ ID NO: 850
  Description of Artificial Sequence: Synthetic polypeptide

SEQ ID NO: 855 - protein, 41 aa, Artificial Sequence
  Description of Artificial Sequence: Synthetic polypeptide
AKHMSMQEGAVTGEGWAAKEFIAWLVKGRVRADLVGDAFDV

SEQ ID NO: 856 - protein, 41 aa, Artificial Sequence
  Description of Artificial Sequence: Synthetic polypeptide
AKHMSMQEGAVTGEGQFAKEFIAWLVKGRVRADLVGDAFDV

SEQ ID NO: 857 - protein, 41 aa, Artificial Sequence; identical to SEQ ID NO: 841
  Description of Artificial Sequence: Synthetic polypeptide

SEQ ID NO: 858 - protein, 41 aa, Artificial Sequence; identical to SEQ ID NO: 850
  Description of Artificial Sequence: Synthetic polypeptide

SEQ ID NO: 859 - protein, 41 aa, Artificial Sequence; identical to SEQ ID NO: 818
  Description of Artificial Sequence: Synthetic polypeptide

SEQ ID NO: 860 - protein, 41 aa, Artificial Sequence; identical to SEQ ID NO: 815
  Description of Artificial Sequence: Synthetic polypeptide

SEQ ID NO: 861 - protein, 41 aa, Artificial Sequence; identical to SEQ ID NO: 815
  Description of Artificial Sequence: Synthetic polypeptide

SEQ ID NO: 862 - protein, 41 aa, Artificial Sequence; identical to SEQ ID NO: 824
  Description of Artificial Sequence: Synthetic polypeptide

SEQ ID NO: 863 - protein, 41 aa, Artificial Sequence; identical to SEQ ID NO: 837
  Description of Artificial Sequence: Synthetic polypeptide

SEQ ID NO: 864 - protein, 41 aa, Artificial Sequence; identical to SEQ ID NO: 824
  Description of Artificial Sequence: Synthetic polypeptide

SEQ ID NO: 865 - protein, 41 aa, Artificial Sequence; identical to SEQ ID NO: 837
  Description of Artificial Sequence: Synthetic polypeptide

SEQ ID NO: 866 - protein, 41 aa, Artificial Sequence; identical to SEQ ID NO: 815
  Description of Artificial Sequence: Synthetic polypeptide

SEQ ID NO: 867 - protein, 41 aa, Artificial Sequence; identical to SEQ ID NO: 850
  Description of Artificial Sequence: Synthetic polypeptide

SEQ ID NO: 868 - protein, 41 aa, Artificial Sequence
  Description of Artificial Sequence: Synthetic polypeptide
AKHMSMQEGAVMGEGQAAKEFIAWLVKGRVRADLVGDAFDV

SEQ ID NO: 869 - protein, 41 aa, Artificial Sequence; identical to SEQ ID NO: 824
  Description of Artificial Sequence: Synthetic polypeptide

SEQ ID NO: 870 - protein, 41 aa, Artificial Sequence; identical to SEQ ID NO: 822
  Description of Artificial Sequence: Synthetic polypeptide

SEQ ID NO: 871 - protein, 41 aa, Artificial Sequence; identical to SEQ ID NO: 825
  Description of Artificial Sequence: Synthetic polypeptide

SEQ ID NO: 872 - protein, 41 aa, Artificial Sequence; identical to SEQ ID NO: 824
  Description of Artificial Sequence: Synthetic polypeptide

SEQ ID NO: 873 - protein, 41 aa, Artificial Sequence
  Description of Artificial Sequence: Synthetic polypeptide
AKHMSMQEGAVTEEGQAAKEFIAWLVKGRVRADLVGDAFDV

SEQ ID NO: 874 - protein, 41 aa, Artificial Sequence; identical to SEQ ID NO: 837
  Description of Artificial Sequence: Synthetic polypeptide

SEQ ID NO: 875 - protein, 41 aa, Artificial Sequence; identical to SEQ ID NO: 825
  Description of Artificial Sequence: Synthetic polypeptide

SEQ ID NO: 876 - protein, 41 aa, Artificial Sequence
  Description of Artificial Sequence: Synthetic polypeptide
AKHMSMQEGAVTGEGQAVKEFIAWLVKGDVRADLVGDAFDV

SEQ ID NO: 877 - protein, 41 aa, Artificial Sequence; identical to SEQ ID NO: 822
  Description of Artificial Sequence: Synthetic polypeptide

SEQ ID NO: 878 - protein, 41 aa, Artificial Sequence; identical to SEQ ID NO: 815
  Description of Artificial Sequence: Synthetic polypeptide

SEQ ID NO: 879 - protein, 41 aa, Artificial Sequence; identical to SEQ ID NO: 837
  Description of Artificial Sequence: Synthetic polypeptide

SEQ ID NO: 880 - protein, 41 aa, Artificial Sequence; identical to SEQ ID NO: 825
  Description of Artificial Sequence: Synthetic polypeptide

SEQ ID NO: 881 - protein, 41 aa, Artificial Sequence; identical to SEQ ID NO: 825
  Description of Artificial Sequence: Synthetic polypeptide

SEQ ID NO: 882 - protein, 41 aa, Artificial Sequence; identical to SEQ ID NO: 837
  Description of Artificial Sequence: Synthetic polypeptide

SEQ ID NO: 883 - protein, 41 aa, Artificial Sequence; identical to SEQ ID NO: 828
  Description of Artificial Sequence: Synthetic polypeptide

SEQ ID NO: 884 - protein, 41 aa, Artificial Sequence; identical to SEQ ID NO: 824
  Description of Artificial Sequence: Synthetic polypeptide

SEQ ID NO: 885 - protein, 41 aa, Artificial Sequence; identical to SEQ ID NO: 825
  Description of Artificial Sequence: Synthetic polypeptide

SEQ ID NO: 886 - protein, 41 aa, Artificial Sequence
  Description of Artificial Sequence: Synthetic polypeptide
AKHMSMQEGAVTGEGQAAKEFIAWLVFGRVRADLVGDAFDV

SEQ ID NO: 887 - protein, 41 aa, Artificial Sequence; identical to SEQ ID NO: 825
  Description of Artificial Sequence: Synthetic polypeptide

SEQ ID NO: 888 - protein, 41 aa, Artificial Sequence
  Description of Artificial Sequence: Synthetic polypeptide
AKHMSMQEGAVTGEGQAWKEFIAWLVKGRVRADLVGDAFDV

SEQ ID NO: 889 - protein, 41 aa, Artificial Sequence; identical to SEQ ID NO: 802
  Description of Artificial Sequence: Synthetic polypeptide

SEQ ID NO: 890 - protein, 41 aa, Artificial Sequence; identical to SEQ ID NO: 830
  Description of Artificial Sequence: Synthetic polypeptide

SEQ ID NO: 891 - protein, 41 aa, Artificial Sequence; identical to SEQ ID NO: 802
  Description of Artificial Sequence: Synthetic polypeptide

SEQ ID NO: 892 - protein, 41 aa, Artificial Sequence; identical to SEQ ID NO: 818
  Description of Artificial Sequence: Synthetic polypeptide

SEQ ID NO: 893 - protein, 41 aa, Artificial Sequence; identical to SEQ ID NO: 818
  Description of Artificial Sequence: Synthetic polypeptide

SEQ ID NO: 894 - protein, 41 aa, Artificial Sequence
  Description of Artificial Sequence: Synthetic polypeptide
AKHMSMQEGAVTGEKQAAKEFIAWLVKGRVRADLVGDAFDV

SEQ ID NO: 895 - protein, 41 aa, Artificial Sequence
  Description of Artificial Sequence: Synthetic polypeptide
AKHMSMQEGAVTGEGQAAKEFIAWLVGGRVRADLVGDAFDV

SEQ ID NO: 896 - protein, 41 aa, Artificial Sequence; identical to SEQ ID NO: 813
  Description of Artificial Sequence: Synthetic polypeptide

SEQ ID NO: 897 - protein, 41 aa, Artificial Sequence; identical to SEQ ID NO: 810
  Description of Artificial Sequence: Synthetic polypeptide

SEQ ID NO: 898 - protein, 41 aa, Artificial Sequence
  Description of Artificial Sequence: Synthetic polypeptide
AKHMSMQEGAVTGEGQAAKEFIAWLVKGFVRADLVGDAFDV

SEQ ID NO: 899 - protein, 41 aa, Artificial Sequence
  Description of Artificial Sequence: Synthetic polypeptide
AKHMSMQEGAVTGYGQAAKEFIAWLVKGFVRADLVGDAFDV

SEQ ID NO: 900 - protein, 41 aa, Artificial Sequence; identical to SEQ ID NO: 818
  Description of Artificial Sequence: Synthetic polypeptide

SEQ ID NO: 901 - protein, 41 aa, Artificial Sequence
  Description of Artificial Sequence: Synthetic polypeptide
AKHMSMQEGAVTGTGQAAKEFIAWLVKGIVRADLVGDAFDV

SEQ ID NO: 902 - protein, 41 aa, Artificial Sequence
  Description of Artificial Sequence: Synthetic polypeptide
AKHMSMQEGAVTREGQAAKEFIAWLVKGRVRADLVGDAFDV

SEQ ID NO: 903 - protein, 41 aa, Artificial Sequence
  Description of Artificial Sequence: Synthetic polypeptide
AKHMSMQEGAVTGEGQAAKEFIAWLVMGRVRADLVGDAFDV

SEQ ID NO: 904 - protein, 41 aa, Artificial Sequence
  Description of Artificial Sequence: Synthetic polypeptide
AKHMSMQEGAVTGEGQAAKEFIAWLVKGWVRADLVGDAFDV

SEQ ID NO: 905 - protein, 41 aa, Artificial Sequence; identical to SEQ ID NO: 810
  Description of Artificial Sequence: Synthetic polypeptide

SEQ ID NO: 906 - protein, 41 aa, Artificial Sequence; identical to SEQ ID NO: 799
  Description of Artificial Sequence: Synthetic polypeptide

SEQ ID NO: 907 - protein, 41 aa, Artificial Sequence
  Description of Artificial Sequence: Synthetic polypeptide
AKHMSMQEGAVTGEGQAAKEFIAWLVKGRVRNDLVGDAFDV

SEQ ID NO: 908 - protein, 41 aa, Artificial Sequence; identical to SEQ ID NO: 810
  Description of Artificial Sequence: Synthetic polypeptide

SEQ ID NO: 909 - protein, 41 aa, Artificial Sequence; identical to SEQ ID NO: 850
  Description of Artificial Sequence: Synthetic polypeptide

SEQ ID NO: 910 - protein, 41 aa, Artificial Sequence
  Description of Artificial Sequence: Synthetic polypeptide
AKHMSMQEGAQTGEGQAAKEFIAWLVKGRVRADLVGDAFDV

SEQ ID NO: 911 - protein, 41 aa, Artificial Sequence
  Description of Artificial Sequence: Synthetic polypeptide
AKHMSMQEGAVTGEGQAAKEFIAWLLKGRVRADLVGDAFDV

SEQ ID NO: 912 - protein, 41 aa, Artificial Sequence; identical to SEQ ID NO: 828
  Description of Artificial Sequence: Synthetic polypeptide

SEQ ID NO: 913 - protein, 41 aa, Artificial Sequence; identical to SEQ ID NO: 855
  Description of Artificial Sequence: Synthetic polypeptide

SEQ ID NO: 914 - protein, 41 aa, Artificial Sequence; identical to SEQ ID NO: 818
  Description of Artificial Sequence: Synthetic polypeptide

SEQ ID NO: 915 - protein, 41 aa, Artificial Sequence
  Description of Artificial Sequence: Synthetic polypeptide
AKHMSMQEGAVTGEGQAAKNFIAWLVKGRVRADLVGDAFDV

SEQ ID NO: 916 - protein, 41 aa, Artificial Sequence; identical to SEQ ID NO: 828
  Description of Artificial Sequence: Synthetic polypeptide

SEQ ID NO: 917 - protein, 41 aa, Artificial Sequence; identical to SEQ ID NO: 818
  Description of Artificial Sequence: Synthetic polypeptide

SEQ ID NO: 918 - protein, 41 aa, Artificial Sequence; identical to SEQ ID NO: 803
  Description of Artificial Sequence: Synthetic polypeptide

SEQ ID NO: 919 - protein, 41 aa, Artificial Sequence
  Description of Artificial Sequence: Synthetic polypeptide
AKHMSMQEGAVTGEGQAAKEFIAWLVKGDVRADLVGDAFDV

SEQ ID NO: 920 - protein, 41 aa, Artificial Sequence; identical to SEQ ID NO: 818
  Description of Artificial Sequence: Synthetic polypeptide

SEQ ID NO: 921 - protein, 41 aa, Artificial Sequence; identical to SEQ ID NO: 911
  Description of Artificial Sequence: Synthetic polypeptide

SEQ ID NO: 922 - protein, 41 aa, Artificial Sequence; identical to SEQ ID NO: 855
  Description of Artificial Sequence: Synthetic polypeptide

SEQ ID NO: 923 - protein, 41 aa, Artificial Sequence
  Description of Artificial Sequence: Synthetic polypeptide
AKHMSMQEGAVQGEGQAAKEFIAWLVKGRVRADLVGDAFDV

SEQ ID NO: 924 - protein, 41 aa, Artificial Sequence
  Description of Artificial Sequence: Synthetic polypeptide
AKHMSMQEGAVTGEIQAAKEFIAWLVKGRVRADLVGDAFDV

SEQ ID NO: 925 - protein, 41 aa, Artificial Sequence; identical to SEQ ID NO: 815
  Description of Artificial Sequence: Synthetic polypeptide

SEQ ID NO: 926 - protein, 41 aa, Artificial Sequence
  Description of Artificial Sequence: Synthetic polypeptide
AKHMSMQEGAVTGEGQAAWEFIAWLVKGRVRADLVGDAFDV

SEQ ID NO: 927 - protein, 41 aa, Artificial Sequence
  Description of Artificial Sequence: Synthetic polypeptide
AKHMSMQEGAVTGEGQAAKSFIAWLVKGRVRADLVGDAFDV

SEQ ID NO: 928 - protein, 41 aa, Artificial Sequence; identical to SEQ ID NO: 815
  Description of Artificial Sequence: Synthetic polypeptide

SEQ ID NO: 929 - protein, 41 aa, Artificial Sequence
  Description of Artificial Sequence: Synthetic polypeptide
AKHMSMQEGAVTGTGQAAKEFIAWLVKGRVRADLVGDAFDV

SEQ ID NO: 930 - protein, 41 aa, Artificial Sequence
  Description of Artificial Sequence: Synthetic polypeptide
AKHMSMQEGAVTGEGYAAKEFIAWLVKGRVRADLVGDAFDV

SEQ ID NO: 931 - protein, 41 aa, Artificial Sequence
  Description of Artificial Sequence: Synthetic polypeptide
AKHMSMQEGAVTGEGQAAVEFIAWLVKGRVRADLVGDAFDV

SEQ ID NO: 932 - protein, 41 aa, Artificial Sequence; identical to SEQ ID NO: 828
  Description of Artificial Sequence: Synthetic polypeptide

SEQ ID NO: 933 - protein, 41 aa, Artificial Sequence
  Description of Artificial Sequence: Synthetic polypeptide
AKHMSMQEGAVTGEAQAAKEFIAWLVKGRVRADLVGDAFDV

SEQ ID NO: 934 - protein, 41 aa, Artificial Sequence
  Description of Artificial Sequence: Synthetic polypeptide
AKHMSMQEGAVTGKGQAAKEFIAWLVKGRVRADLVGDAFDV

SEQ ID NO: 935 - protein, 41 aa, Artificial Sequence
  Description of Artificial Sequence: Synthetic polypeptide
AKHMSMQEGAVTGEGQAAYEFIAWLVKGRVRADLVGDAFDV

SEQ ID NO: 936 - protein, 41 aa, Artificial Sequence; identical to SEQ ID NO: 828
  Description of Artificial Sequence: Synthetic polypeptide

SEQ ID NO: 937 - protein, 41 aa, Artificial Sequence; identical to SEQ ID NO: 828
  Description of Artificial Sequence: Synthetic polypeptide

SEQ ID NO: 938 - protein, 41 aa, Artificial Sequence
  Description of Artificial Sequence: Synthetic polypeptide
AKHMSMQEGAVTGEGWAAKEFIFWLVKGRVRADLVGDAFDV

SEQ ID NO: 939 - protein, 41 aa, Artificial Sequence; identical to SEQ ID NO: 828
  Description of Artificial Sequence: Synthetic polypeptide

SEQ ID NO: 940 - protein, 41 aa, Artificial Sequence; identical to SEQ ID NO: 929
  Description of Artificial Sequence: Synthetic polypeptide

SEQ ID NO: 941 - protein, 41 aa, Artificial Sequence; identical to SEQ ID NO: 818
  Description of Artificial Sequence: Synthetic polypeptide

SEQ ID NO: 942 - protein, 41 aa, Artificial Sequence
  Description of Artificial Sequence: Synthetic polypeptide
AKHMSMQEGAVTGEGQAAKEFIAWLVKGRVRPDLVGDAFDV

SEQ ID NO: 943 - protein, 41 aa, Artificial Sequence; identical to SEQ ID NO: 929
  Description of Artificial Sequence: Synthetic polypeptide

SEQ ID NO: 944 - protein, 41 aa, Artificial Sequence; identical to SEQ ID NO: 810
  Description of Artificial Sequence: Synthetic polypeptide

SEQ ID NO: 945 - protein, 41 aa, Artificial Sequence; identical to SEQ ID NO: 815
  Description of Artificial Sequence: Synthetic polypeptide

SEQ ID NO: 946 - protein, 41 aa, Artificial Sequence
  Description of Artificial Sequence: Synthetic polypeptide
AKHMSMQEGAVTGEGFAAKEFIAWLVKGRVRADLVGDAFDV

SEQ ID NO: 947 - protein, 41 aa, Artificial Sequence; identical to SEQ ID NO: 904
  Description of Artificial Sequence: Synthetic polypeptide

SEQ ID NO: 948 - protein, 41 aa, Artificial Sequence; identical to SEQ ID NO: 830
  Description of Artificial Sequence: Synthetic polypeptide

SEQ ID NO: 949 - protein, 41 aa, Artificial Sequence; identical to SEQ ID NO: 818
  Description of Artificial Sequence: Synthetic polypeptide

SEQ ID NO: 950 - protein, 41 aa, Artificial Sequence; identical to SEQ ID NO: 822
  Description of Artificial Sequence: Synthetic polypeptide

SEQ ID NO: 951 - protein, 41 aa, Artificial Sequence; identical to SEQ ID NO: 844
  Description of Artificial Sequence: Synthetic polypeptide

SEQ ID NO: 952 - protein, 41 aa, Artificial Sequence
  Description of Artificial Sequence: Synthetic polypeptide
AKHMSMQEGAVTGEGQWAKEFIAWLVKGRVRADLVGDAFDV

SEQ ID NO: 953 - protein, 41 aa, Artificial Sequence; identical to SEQ ID NO: 837
  Description of Artificial Sequence: Synthetic polypeptide

SEQ ID NO: 954 - protein, 41 aa, Artificial Sequence; identical to SEQ ID NO: 841
  Description of Artificial Sequence: Synthetic polypeptide

SEQ ID NO: 955 - protein, 41 aa, Artificial Sequence; identical to SEQ ID NO: 837
  Description of Artificial Sequence: Synthetic polypeptide

SEQ ID NO: 956 - protein, 41 aa, Artificial Sequence; identical to SEQ ID NO: 809
  Description of Artificial Sequence: Synthetic polypeptide

SEQ ID NO: 957 - protein, 41 aa, Artificial Sequence; identical to SEQ ID NO: 818
  Description of Artificial Sequence: Synthetic polypeptide

SEQ ID NO: 958 - protein, 41 aa, Artificial Sequence
  Description of Artificial Sequence: Synthetic polypeptide
AKHMSMQEGAVTGHGQAAKEFIAWLVKGRVRADLVGDAFDV

SEQ ID NO: 959 - protein, 41 aa, Artificial Sequence; identical to SEQ ID NO: 855
  Description of Artificial Sequence: Synthetic polypeptide

SEQ ID NO: 960 - protein, 41 aa, Artificial Sequence; identical to SEQ ID NO: 915
  Description of Artificial Sequence: Synthetic polypeptide

SEQ ID NO: 961 - protein, 41 aa, Artificial Sequence; identical to SEQ ID NO: 958
  Description of Artificial Sequence: Synthetic polypeptide

SEQ ID NO: 962 - protein, 41 aa, Artificial Sequence; identical to SEQ ID NO: 813
  Description of Artificial Sequence: Synthetic polypeptide

SEQ ID NO: 963 - protein, 41 aa, Artificial Sequence; identical to SEQ ID NO: 802
  Description of Artificial Sequence: Synthetic polypeptide

SEQ ID NO: 964 - protein, 41 aa, Artificial Sequence; identical to SEQ ID NO: 805
  Description of Artificial Sequence: Synthetic polypeptide

SEQ ID NO: 965 - protein, 41 aa, Artificial Sequence; identical to SEQ ID NO: 946
  Description of Artificial Sequence: Synthetic polypeptide

SEQ ID NO: 966 - protein, 41 aa, Artificial Sequence; identical to SEQ ID NO: 828
  Description of Artificial Sequence: Synthetic polypeptide

SEQ ID NO: 967 - protein, 41 aa, Artificial Sequence; identical to SEQ ID NO: 855
  Description of Artificial Sequence: Synthetic polypeptide

SEQ ID NO: 968 - protein, 41 aa, Artificial Sequence
  Description of Artificial Sequence: Synthetic polypeptide
AKHMSMQEGAVTGEGPAAKEFIAWLVKGRVRADLVGDAFDV

SEQ ID NO: 969 - protein, 41 aa, Artificial Sequence; identical to SEQ ID NO: 898
  Description of Artificial Sequence: Synthetic polypeptide

SEQ ID NO: 970 - protein, 41 aa, Artificial Sequence; identical to SEQ ID NO: 850
  Description of Artificial Sequence: Synthetic polypeptide

SEQ ID NO: 971 - protein, 41 aa, Artificial Sequence; identical to SEQ ID NO: 815
  Description of Artificial Sequence: Synthetic polypeptide

SEQ ID NO: 972 - protein, 41 aa, Artificial Sequence; identical to SEQ ID NO: 813
  Description of Artificial Sequence: Synthetic polypeptide

SEQ ID NO: 973 - protein, 41 aa, Artificial Sequence
  Description of Artificial Sequence: Synthetic polypeptide
AKHMSMQEGAVTGEGQSAKEFIAWLVKGRVRADLVGDAFDV

SEQ ID NO: 974 - protein, 41 aa, Artificial Sequence; identical to SEQ ID NO: 824
  Description of Artificial Sequence: Synthetic polypeptide

SEQ ID NO: 975 - protein, 41 aa, Artificial Sequence; identical to SEQ ID NO: 807
  Description of Artificial Sequence: Synthetic polypeptide

SEQ ID NO: 976 - protein, 41 aa, Artificial Sequence; identical to SEQ ID NO: 942
  Description of Artificial Sequence: Synthetic polypeptide

SEQ ID NO: 977 - protein, 41 aa, Artificial Sequence; identical to SEQ ID NO: 837
  Description of Artificial Sequence: Synthetic polypeptide

SEQ ID NO: 978 - protein, 8 aa, Artificial Sequence
  Description of Artificial Sequence: Synthetic peptide
SSNIADNY

SEQ ID NO: 979 - protein, 8 aa, Artificial Sequence
  Description of Artificial Sequence: Synthetic peptide
TSNIANNF

SEQ ID NO: 980 - protein, 8 aa, Artificial Sequence
  Description of Artificial Sequence: Synthetic peptide
GSNIGNND

SEQ ID NO: 981 - protein, 8 aa, Artificial Sequence
  Description of Artificial Sequence: Synthetic peptide
SSNIGNTY

SEQ ID NO: 982 - protein, 8 aa, Artificial Sequence
  Description of Artificial Sequence: Synthetic peptide
SSNIGNEY

SEQ ID NO: 983 - protein, 8 aa, Artificial Sequence
  Description of Artificial Sequence: Synthetic peptide
SSNIGNND

SEQ ID NO: 984 - protein, 8 aa, Artificial Sequence
  Description of Artificial Sequence: Synthetic peptide
TSNIANNF

SEQ ID NO: 985 - protein, 8 aa, Artificial Sequence
  Description of Artificial Sequence: Synthetic peptide
SSNIGNNP

SEQ ID NO: 986 - protein, 8 aa, Artificial Sequence
  Description of Artificial Sequence: Synthetic peptide
SSNIGNNY

SEQ ID NO: 987 - protein, 8 aa, Artificial Sequence
  Description of Artificial Sequence: Synthetic peptide
SSNIADNY

SEQ ID NO: 988 - protein, 8 aa, Artificial Sequence
  Description of Artificial Sequence: Synthetic peptide
SSNIGNQY

SEQ ID NO: 989 - protein, 8 aa, Artificial Sequence
  Description of Artificial Sequence: Synthetic peptide
SSNIGRNF

SEQ ID NO: 990 - protein, 8 aa, Artificial Sequence
  Description of Artificial Sequence: Synthetic peptide
SSNIGNND

SEQ ID NO: 991 - protein, 8 aa, Artificial Sequence
  Description of Artificial Sequence: Synthetic peptide
SSTIGNNY

SEQ ID NO: 992 - protein, 8 aa, Artificial Sequence
  Description of Artificial Sequence: Synthetic peptide
SSNIGNKY

SEQ ID NO: 993 - protein, 8 aa, Artificial Sequence
  Description of Artificial Sequence: Synthetic peptide
SSNIGNDY

SEQ ID NO: 994 - protein, 8 aa, Artificial Sequence
  Description of Artificial Sequence: Synthetic peptide
SSNIGSKD

SEQ ID NO: 995 - protein, 8 aa, Artificial Sequence
  Description of Artificial Sequence: Synthetic peptide
SSNIGDND

SEQ ID NO: 996 - protein, 8 aa, Artificial Sequence
  Description of Artificial Sequence: Synthetic peptide
SSNIGSKY

SEQ ID NO: 997 - protein, 8 aa, Artificial Sequence
  Description of Artificial Sequence: Synthetic peptide
SSNIGNNP

SEQ ID NO: 998 - protein, 8 aa, Artificial Sequence
  Description of Artificial Sequence: Synthetic peptide
SSNIGNKY

SEQ ID NO: 999 - protein, 8 aa, Artificial Sequence
  Description of Artificial Sequence: Synthetic peptide
SSNIGSHY

SEQ ID NO: 1000 - protein, 8 aa, Artificial Sequence
  Description of Artificial Sequence: Synthetic peptide
SSTIGNNY

SEQ ID NO: 1001 - protein, 8 aa, Artificial Sequence
  Description of Artificial Sequence: Synthetic peptide
TSNIGNNH

SEQ ID NO: 1002 - protein, 8 aa, Artificial Sequence
  Description of Artificial Sequence: Synthetic peptide
SSNIGSNY

SEQ ID NO: 1003 - protein, 8 aa, Artificial Sequence
  Description of Artificial Sequence: Synthetic peptide
GSNIGNND

SEQ ID NO: 1004 - protein, 8 aa, Artificial Sequence
  Description of Artificial Sequence: Synthetic peptide
SSNIGSKY

SEQ ID NO: 1005 - protein, 8 aa, Artificial Sequence
  Description of Artificial Sequence: Synthetic peptide
SSNIGNND

SEQ ID NO: 1006 - protein, 8 aa, Artificial Sequence
  Description of Artificial Sequence: Synthetic peptide
SSNIGNDF

SEQ ID NO: 1007 - protein, 8 aa, Artificial Sequence
  Description of Artificial Sequence: Synthetic peptide
SSNIGNNF

SEQ ID NO: 1008 - protein, 8 aa, Artificial Sequence
  Description of Artificial Sequence: Synthetic peptide
SSNIGNND

SEQ ID NO: 1009 - protein, 8 aa, Artificial Sequence
  Description of Artificial Sequence: Synthetic peptide
SSNIGNHD

SEQ ID NO: 1010 - protein, 8 aa, Artificial Sequence
  Description of Artificial Sequence: Synthetic peptide
SSNIGSNF

SEQ ID NO: 1011 - protein, 8 aa, Artificial Sequence
  Description of Artificial Sequence: Synthetic peptide
SSNIGDND

SEQ ID NO: 1012 - protein, 8 aa, Artificial Sequence
  Description of Artificial Sequence: Synthetic peptide
SSNIGNND

SEQ ID NO: 1013 - protein, 8 aa, Artificial Sequence
  Description of Artificial Sequence: Synthetic peptide
SSNIGDND

SEQ ID NO: 1014 - protein, 8 aa, Artificial Sequence
  Description of Artificial Sequence: Synthetic peptide
SSNIGKNF

SEQ ID NO: 1015 - protein, 8 aa, Artificial Sequence
  Description of Artificial Sequence: Synthetic peptide
SSNIGNEY

SEQ ID NO: 1016 - protein, 8 aa, Artificial Sequence
  Description of Artificial Sequence: Synthetic peptide
SSNIGSKY

SEQ ID NO: 1017 - protein, 8 aa, Artificial Sequence
  Description of Artificial Sequence: Synthetic peptide
SSDIGNKY

SEQ ID NO: 1018 - protein, 8 aa, Artificial Sequence
  Description of Artificial Sequence: Synthetic peptide
SSNIGNNF

SEQ ID NO: 1019 - protein, 8 aa, Artificial Sequence
  Description of Artificial Sequence: Synthetic peptide
SSNIGSNY

SEQ ID NO: 1020 - protein, 8 aa, Artificial Sequence
  Description of Artificial Sequence: Synthetic peptide
SSNIGNKY

SEQ ID NO: 1021 - protein, 8 aa, Artificial Sequence
  Description of Artificial Sequence: Synthetic peptide
SSNIGKDY

SEQ ID NO: 1022 - protein, 8 aa, Artificial Sequence
  Description of Artificial Sequence: Synthetic peptide
TSNIGNND

SEQ ID NO: 1023 - protein, 8 aa, Artificial Sequence
  Description of Artificial Sequence: Synthetic peptide
GSNIGNND

SEQ ID NO: 1024 - protein, 8 aa, Artificial Sequence
  Description of Artificial Sequence: Synthetic peptide
TSNIGNNY

SEQ ID NO: 1025 - protein, 8 aa, Artificial Sequence
  Description of Artificial Sequence: Synthetic peptide
SSNIGRNF

SEQ ID NO: 1026 - protein, 8 aa, Artificial Sequence
  Description of Artificial Sequence: Synthetic peptide
SSNIGKDY

SEQ ID NO: 1027 - protein, 8 aa, Artificial Sequence
  Description of Artificial Sequence: Synthetic peptide
SSNIGSND

SEQ ID NO: 1028 - protein, 8 aa, Artificial Sequence
  Description of Artificial Sequence: Synthetic peptide
SSNIGKHY

SEQ ID NO: 1029 - protein, 8 aa, Artificial Sequence
  Description of Artificial Sequence: Synthetic peptide
SSNIGSNY

SEQ ID NO: 1030 - protein, 8 aa, Artificial Sequence
  Description of Artificial Sequence: Synthetic peptide
SSNIGNNY

SEQ ID NO: 1031 - protein, 8 aa, Artificial Sequence
  Description of Artificial Sequence: Synthetic peptide
SSNIGNKY

SEQ ID NO: 1032 - protein, 8 aa, Artificial Sequence
  Description of Artificial Sequence: Synthetic peptide
SSNIGKYY

SEQ ID NO: 1033 - protein, 8 aa, Artificial Sequence
  Description of Artificial Sequence: Synthetic peptide
SSNIGSNL

SEQ ID NO: 1034 - protein, 8 aa, Artificial Sequence
  Description of Artificial Sequence: Synthetic peptide
RSNIGNYY

SEQ ID NO: 1035 - protein, 8 aa, Artificial Sequence
  Description of Artificial Sequence: Synthetic peptide
SSNIGNNF

SEQ ID NO: 1036 - protein, 8 aa, Artificial Sequence
  Description of Artificial Sequence: Synthetic peptide
SSNIGNKY

SEQ ID NO: 1037 - protein, 8 aa, Artificial Sequence
  Description of Artificial Sequence: Synthetic peptide
SSNIENND

SEQ ID NO: 1038 - protein, 8 aa, Artificial Sequence
  Description of Artificial Sequence: Synthetic peptide
SSNIGSNH

SEQ ID NO: 1039 - protein, 8 aa, Artificial Sequence
  Description of Artificial Sequence: Synthetic peptide
SSTIGNNY

SEQ ID NO: 1040 - protein, 8 aa, Artificial Sequence
  Description of Artificial Sequence: Synthetic peptide
SSNIGSKD

SEQ ID NO: 1041 - protein, 8 aa, Artificial Sequence
  Description of Artificial Sequence: Synthetic peptide
SSNIGKDF

SEQ ID NO: 1042 - protein, 8 aa, Artificial Sequence
  Description of Artificial Sequence: Synthetic peptide
SSNIGKDY

SEQ ID NO: 1043 - protein, 8 aa, Artificial Sequence
  Description of Artificial Sequence: Synthetic peptide
SSNIGSNY

SEQ ID NO: 1044 - protein, 8 aa, Artificial Sequence
  Description of Artificial Sequence: Synthetic peptide
SSNIGSND

SEQ ID NO: 1045 - protein, 8 aa, Artificial Sequence
  Description of Artificial Sequence: Synthetic peptide
SSNIGNND

SEQ ID NO: 1046 - protein, 8 aa, Artificial Sequence
  Description of Artificial Sequence: Synthetic peptide
SSNIGNHF

SEQ ID NO: 1047 - protein, 8 aa, Artificial Sequence
  Description of Artificial Sequence: Synthetic peptide
SSNIGNNP

SEQ ID NO: 1048 - protein, 8 aa, Artificial Sequence
  Description of Artificial Sequence: Synthetic peptide
SSTIGNNY

SEQ ID NO: 1049 - protein, 8 aa, Artificial Sequence
  Description of Artificial Sequence: Synthetic peptide
SSTIGNNY

SEQ ID NO: 1050 - protein, 8 aa, Artificial Sequence
  Description of Artificial Sequence: Synthetic peptide
SSNIGSNH

SEQ ID NO: 1051 - protein, 8 aa, Artificial Sequence
  Description of Artificial Sequence: Synthetic peptide
SSNIGSKY

SEQ ID NO: 1052 - protein, 8 aa, Artificial Sequence
  Description of Artificial Sequence: Synthetic peptide
SSNIGKYY

SEQ ID NO: 1053 - protein, 8 aa, Artificial Sequence
  Description of Artificial Sequence: Synthetic peptide
SSNIGNND

SEQ ID NO: 1054 - protein, 8 aa, Artificial Sequence
  Description of Artificial Sequence: Synthetic peptide
SSNIENNH

SEQ ID NO: 1055 - protein, 8 aa, Artificial Sequence
  Description of Artificial Sequence: Synthetic peptide
SSNIGKYY

SEQ ID NO: 1056 - protein, 8 aa, Artificial Sequence
  Description of Artificial Sequence: Synthetic peptide
SSSIGNNY

SEQ ID NO: 1057 - protein, 8 aa, Artificial Sequence
  Description of Artificial Sequence: Synthetic peptide
SSNIGNNF

SEQ ID NO: 1058 - protein, 8 aa, Artificial Sequence
  Description of Artificial Sequence: Synthetic peptide
SSNIGNNY

SEQ ID NO: 1059 - protein, 8 aa, Artificial Sequence
  Description of Artificial Sequence: Synthetic peptide
SSNIGSND

SEQ ID NO: 1060 - protein, 8 aa, Artificial Sequence
  Description of Artificial Sequence: Synthetic peptide
SSNIGNNY

SEQ ID NO: 1061 - protein, 8 aa, Artificial Sequence
  Description of Artificial Sequence: Synthetic peptide
SSNIGTNF

SEQ ID NO: 1062 - protein, 8 aa, Artificial Sequence
  Description of Artificial Sequence: Synthetic peptide
SSNIGKDY

SEQ ID NO: 1063 - protein, 8 aa, Artificial Sequence
  Description of Artificial Sequence: Synthetic peptide
SSNIENNH

SEQ ID NO: 1064 - protein, 8 aa, Artificial Sequence
  Description of Artificial Sequence: Synthetic peptide
SSNIGNNH

SEQ ID NO: 1065 - protein, 8 aa, Artificial Sequence
  Description of Artificial Sequence: Synthetic peptide
SSNIGNND

SEQ ID NO: 1066 - protein, 8 aa, Artificial Sequence
  Description of Artificial Sequence: Synthetic peptide
SSTIGNNY

SEQ ID NO: 1067 - protein, 8 aa, Artificial Sequence
  Description of Artificial Sequence: Synthetic peptide
SSNIGNEY

SEQ ID NO: 1068 - protein, 8 aa, Artificial Sequence
  Description of Artificial Sequence: Synthetic peptide
SSNIGNHD

SEQ ID NO: 1069 - protein, 8 aa, Artificial Sequence
  Description of Artificial Sequence: Synthetic peptide
SSNIGKRS

SEQ ID NO: 1070 - protein, 8 aa, Artificial Sequence
  Description of Artificial Sequence: Synthetic peptide
SSNIENND

SEQ ID NO: 1071 - protein, 8 aa, Artificial Sequence
  Description of Artificial Sequence: Synthetic peptide
SSNIGNND

SEQ ID NO: 1072 - protein, 8 aa, Artificial Sequence
  Description of Artificial Sequence: Synthetic peptide
SSNIGNHD

SEQ ID NO: 1073 - protein, 8 aa, Artificial Sequence
  Description of Artificial Sequence: Synthetic peptide
SSNIADNY

SEQ ID NO: 1074 - protein, 8 aa, Artificial Sequence
  Description of Artificial Sequence: Synthetic peptide
GSNIGNND

SEQ ID NO: 1075 - protein, 8 aa, Artificial Sequence
  Description of Artificial Sequence: Synthetic peptide
SSNIGNND

SEQ ID NO: 1076 - protein, 8 aa, Artificial Sequence
  Description of Artificial Sequence: Synthetic peptide
SSNIGSKY

SEQ ID NO: 1077 - protein, 8 aa, Artificial Sequence
  Description of Artificial Sequence: Synthetic peptide
SSNIGSDY

SEQ ID NO: 1078 - protein, 8 aa, Artificial Sequence
  Description of Artificial Sequence: Synthetic peptide
SSNIGSNY

SEQ ID NO: 1079 - protein, 8 aa, Artificial Sequence
  Description of Artificial Sequence: Synthetic peptide
SSNIGNNP

SEQ ID NO: 1080 - protein, 8 aa, Artificial Sequence
  Description of Artificial Sequence: Synthetic peptide
SSNIGNYY

SEQ ID NO: 1081 - protein, 8 aa, Artificial Sequence
  Description of Artificial Sequence: Synthetic peptide
SSNIGNND

SEQ ID NO: 1082 - protein, 8 aa, Artificial Sequence
  Description of Artificial Sequence: Synthetic peptide
SSNIGSDY

SEQ ID NO: 1083 - protein, 8 aa, Artificial Sequence
  Description of Artificial Sequence: Synthetic peptide
SSDIGNKY

SEQ ID NO: 1084 - protein, 8 aa, Artificial Sequence
  Description of Artificial Sequence: Synthetic peptide
SSNIGSNH

SEQ ID NO: 1085 - protein, 8 aa, Artificial Sequence
  Description of Artificial Sequence: Synthetic peptide
TSNIGSNF

SEQ ID NO: 1086 - protein, 8 aa, Artificial Sequence
  Description of Artificial Sequence: Synthetic peptide
SSNIENND

SEQ ID NO: 1087 - protein, 8 aa, Artificial Sequence
  Description of Artificial Sequence: Synthetic peptide
SSSIGNNY

SEQ ID NO: 1088 - protein, 8 aa, Artificial Sequence
  Description of Artificial Sequence: Synthetic peptide
SSNIGSKY

SEQ ID NO: 1089 - protein, 8 aa, Artificial Sequence
  Description of Artificial Sequence: Synthetic peptide
SSNIGNND

SEQ ID NO: 1090 - protein, 8 aa, Artificial Sequence
  Description of Artificial Sequence: Synthetic peptide
SSNIGNNY

SEQ ID NO: 1091 - protein, 8 aa, Artificial Sequence
  Description of Artificial Sequence: Synthetic peptide
TSNIGNNY

SEQ ID NO: 1092 - protein, 8 aa, Artificial Sequence
  Description of Artificial Sequence: Synthetic peptide
SSNIGNDY

SEQ ID NO: 1093 - protein, 8 aa, Artificial Sequence
  Description of Artificial Sequence: Synthetic peptide
SSNIGNDY

SEQ ID NO: 1094 - protein, 8 aa, Artificial Sequence
  Description of Artificial Sequence: Synthetic peptide
SSNIGNND

SEQ ID NO: 1095 - protein, 8 aa, Artificial Sequence
  Description of Artificial Sequence: Synthetic peptide
SSNIENND

SEQ ID NO: 1096 - protein, 8 aa, Artificial Sequence
  Description of Artificial Sequence: Synthetic peptide
RSNIGNNF

SEQ ID NO: 1097 - protein, 8 aa, Artificial Sequence
  Description of Artificial Sequence: Synthetic peptide
SSSIGNNY

SEQ ID NO: 1098 - protein, 8 aa, Artificial Sequence
  Description of Artificial Sequence: Synthetic peptide
SSNIGNND

SEQ ID NO: 1099 - protein, 8 aa, Artificial Sequence
  Description of Artificial Sequence: Synthetic peptide
SSNIGSKY

SEQ ID NO: 1100 - protein, 8 aa, Artificial Sequence
  Description of Artificial Sequence: Synthetic peptide
SSNIGSKY

SEQ ID NO: 1101 - protein, 8 aa, Artificial Sequence
  Description of Artificial Sequence: Synthetic peptide
SSNIGSKD

SEQ ID NO: 1102 - protein, 8 aa, Artificial Sequence
  Description of Artificial Sequence: Synthetic peptide
TSNIGNNY

SEQ ID NO: 1103 - protein, 8 aa, Artificial Sequence
  Description of Artificial Sequence: Synthetic peptide
SSNIGSHY

SEQ ID NO: 1104 - protein, 8 aa, Artificial Sequence
  Description of Artificial Sequence: Synthetic peptide
SSDIGNKY

SEQ ID NO: 1105 - protein, 8 aa, Artificial Sequence
  Description of Artificial Sequence: Synthetic peptide
SSNIGNND

SEQ ID NO: 1106 - protein, 8 aa, Artificial Sequence
  Description of Artificial Sequence: Synthetic peptide
TSNIGNNY

SEQ ID NO: 1107 - protein, 8 aa, Artificial Sequence
  Description of Artificial Sequence: Synthetic peptide
TSNIGNNH

SEQ ID NO: 1108 - protein, 8 aa, Artificial Sequence
  Description of Artificial Sequence: Synthetic peptide
SSTIGNNY

SEQ ID NO: 1109 - protein, 8 aa, Artificial Sequence
  Description of Artificial Sequence: Synthetic peptide
RSNIGNYY

SEQ ID NO: 1110 - protein, 8 aa, Artificial Sequence
  Description of Artificial Sequence: Synthetic peptide
SSNIGSKY

SEQ ID NO: 1111 - protein, 8 aa, Artificial Sequence
  Description of Artificial Sequence: Synthetic peptide
SSNIGSNY

SEQ ID NO: 1112 - protein, 8 aa, Artificial Sequence
  Description of Artificial Sequence: Synthetic peptide
SSTIGNNY

SEQ ID NO: 1113 - protein, 8 aa, Artificial Sequence
  Description of Artificial Sequence: Synthetic peptide
SSNIGSKD

SEQ ID NO: 1114 - protein, 8 aa, Artificial Sequence
  Description of Artificial Sequence: Synthetic peptide
TSNIGNNH

SEQ ID NO: 1115 - protein, 8 aa, Artificial Sequence
  Description of Artificial Sequence: Synthetic peptide
SSNIGNHF

SEQ ID NO: 1116 - protein, 8 aa, Artificial Sequence
  Description of Artificial Sequence: Synthetic peptide
SSNIGKYY

SEQ ID NO: 1117 - protein, 8 aa, Artificial Sequence
  Description of Artificial Sequence: Synthetic peptide
SSNIGNND

SEQ ID NO: 1118 - protein, 8 aa, Artificial Sequence
  Description of Artificial Sequence: Synthetic peptide
SSNIGNTY

SEQ ID NO: 1119 - protein, 8 aa, Artificial Sequence
  Description of Artificial Sequence: Synthetic peptide
SSNIGSDY

SEQ ID NO: 1120 - protein, 8 aa, Artificial Sequence
  Description of Artificial Sequence: Synthetic peptide
TSNIGKNF

SEQ ID NO: 1121 - protein, 8 aa, Artificial Sequence
  Description of Artificial Sequence: Synthetic peptide
SSNIGKYY

SEQ ID NO: 1122 - protein, 8 aa, Artificial Sequence
  Description of Artificial Sequence: Synthetic peptide
SSNIGDND

SEQ ID NO: 1123 - protein, 8 aa, Artificial Sequence
  Description of Artificial Sequence: Synthetic peptide
SSNIGKNF

SEQ ID NO: 1124 - protein, 8 aa, Artificial Sequence
  Description of Artificial Sequence: Synthetic peptide
SSNIGSKY

SEQ ID NO: 1125 - protein, 8 aa, Artificial Sequence
  Description of Artificial Sequence: Synthetic peptide
SSNIGSKD

SEQ ID NO: 1126 - protein, 8 aa, Artificial Sequence
  Description of Artificial Sequence: Synthetic peptide
SSNIGNKY

SEQ ID NO: 1127 - protein, 8 aa, Artificial Sequence
  Description of Artificial Sequence: Synthetic peptide
SSNIGNNF

SEQ ID NO: 1128 - protein, 8 aa, Artificial Sequence
  Description of Artificial Sequence: Synthetic peptide
SSNIGSND

SEQ ID NO: 1129 - protein, 8 aa, Artificial Sequence
  Description of Artificial Sequence: Synthetic peptide
SSNIGNQY

SEQ ID NO: 1130 - protein, 8 aa, Artificial Sequence
  Description of Artificial Sequence: Synthetic peptide
SSNIGNND

SEQ ID NO: 1131 - protein, 8 aa, Artificial Sequence
  Description of Artificial Sequence: Synthetic peptide
SSNIGNNP

SEQ ID NO: 1132 - protein, 8 aa, Artificial Sequence
  Description of Artificial Sequence: Synthetic peptide
SSNIGNNL

SEQ ID NO: 1133 - protein, 8 aa, Artificial Sequence
  Description of Artificial Sequence: Synthetic peptide
SSNIGNKY

SEQ ID NO: 1134 - protein, 8 aa, Artificial Sequence
  Description of Artificial Sequence: Synthetic peptide
SSNIGNNY

SEQ ID NO: 1135 - protein, 8 aa, Artificial Sequence
  Description of Artificial Sequence: Synthetic peptide
SSNIGSKY

SEQ ID NO: 1136 - protein, 8 aa, Artificial Sequence
  Description of Artificial Sequence: Synthetic peptide
SSNIGSKY

SEQ ID NO: 1137 - protein, 8 aa, Artificial Sequence
  Description of Artificial Sequence: Synthetic peptide
RSNIGNNF

SEQ ID NO: 1138 - protein, 8 aa, Artificial Sequence
  Description of Artificial Sequence: Synthetic peptide
RSNIGNNF

SEQ ID NO: 1139 - protein, 8 aa, Artificial Sequence
  Description of Artificial Sequence: Synthetic peptide
RSNIGNNF

SEQ ID NO: 1140 - protein, 8 aa, Artificial Sequence
  Description of Artificial Sequence: Synthetic peptide
SSNIGNEY

SEQ ID NO: 1141 - protein, 8 aa, Artificial Sequence
  Description of Artificial Sequence: Synthetic peptide
SSNIGNEY

SEQ ID NO: 1142 - protein, 8 aa, Artificial Sequence
  Description of Artificial Sequence: Synthetic peptide
RSNIGNNF

SEQ ID NO: 1143 - protein, 8 aa, Artificial Sequence
  Description of Artificial Sequence: Synthetic peptide
SSNIGNND

SEQ ID NO: 1144 - protein, 8 aa, Artificial Sequence
  Description of Artificial Sequence: Synthetic peptide
SSNIGKNF

SEQ ID NO: 1145 - protein, 8 aa, Artificial Sequence
  Description of Artificial Sequence: Synthetic peptide
SSNIGTNF

SEQ ID NO: 1146 - protein, 8 aa, Artificial Sequence
  Description of Artificial Sequence: Synthetic peptide
SSNIGNNP

SEQ ID NO: 1147 - protein, 8 aa, Artificial Sequence
  Description of Artificial Sequence: Synthetic peptide
SSNIGNND

SEQ ID NO: 1148 - protein, 8 aa, Artificial Sequence
  Description of Artificial Sequence: Synthetic peptide
SSNIGNNH

SEQ ID NO: 1149 - protein, 8 aa, Artificial Sequence
  Description of Artificial Sequence: Synthetic peptide
SSNIGNHD

SEQ ID NO: 1150 - protein, 8 aa, Artificial Sequence
  Description of Artificial Sequence: Synthetic peptide
SSNIGDHY

SEQ ID NO: 1151 - protein, 8 aa, Artificial Sequence
  Description of Artificial Sequence: Synthetic peptide
SSNIGNNY

SEQ ID NO: 1152 - protein, 8 aa, Artificial Sequence
  Description of Artificial Sequence: Synthetic peptide
SSNIGNHD

SEQ ID NO: 1153 - protein, 8 aa, Artificial Sequence
  Description of Artificial Sequence: Synthetic peptide
SSNIGNNP

SEQ ID NO: 1154 - protein, 8 aa, Artificial Sequence
  Description of Artificial Sequence: Synthetic peptide
SSNIGSNY

SEQ ID NO: 1155 - protein, 8 aa, Artificial Sequence
  Description of Artificial Sequence: Synthetic peptide
SSNIGNNY

SEQ ID NO: 1156 - protein, 8 aa, Artificial Sequence
  Description of Artificial Sequence: Synthetic peptide
SSNIGNTY

SEQ ID NO: 1157 - protein, 3 aa, Artificial Sequence
  Description of Artificial Sequence: Synthetic peptide
DNN

SEQ ID NO: 1158 - protein, 3 aa, Artificial Sequence
  Description of Artificial Sequence: Synthetic peptide
DHN

SEQ ID NO: 1159 - protein, 3 aa, Artificial Sequence
  Description of Artificial Sequence: Synthetic peptide
DND

SEQ ID NO: 1160 - protein, 3 aa, Artificial Sequence
  Description of Artificial Sequence: Synthetic peptide
DDY

SEQ ID NO: 1161 - protein, 3 aa, Artificial Sequence
  Description of Artificial Sequence: Synthetic peptide
DNN

SEQ ID NO: 1162 - protein, 3 aa, Artificial Sequence
  Description of Artificial Sequence: Synthetic peptide
ENN

SEQ ID NO: 1163 - protein, 3 aa, Artificial Sequence
  Description of Artificial Sequence: Synthetic peptide
DNN

SEQ ID NO: 1164 - protein, 3 aa, Artificial Sequence
  Description of Artificial Sequence: Synthetic peptide
END

SEQ ID NO: 1165 - protein, 3 aa, Artificial Sequence
  Description of Artificial Sequence: Synthetic peptide
ENN

SEQ ID NO: 1166 - protein, 3 aa, Artificial Sequence
  Description of Artificial Sequence: Synthetic peptide
ENN

SEQ ID NO: 1167 - protein, 3 aa, Artificial Sequence
  Description of Artificial Sequence: Synthetic peptide
DDH

SEQ ID NO: 1168 - protein, 3 aa, Artificial Sequence
  Description of Artificial Sequence: Synthetic peptide
DHN

SEQ ID NO: 1169 - protein, 3 aa, Artificial Sequence
  Description of Artificial Sequence: Synthetic peptide
DNN

SEQ ID NO: 1170 - protein, 3 aa, Artificial Sequence
  Description of Artificial Sequence: Synthetic peptide
EDD

SEQ ID NO: 1171 - protein, 3 aa, Artificial Sequence
  Description of Artificial Sequence: Synthetic peptide
DDD

SEQ ID NO: 1172 - protein, 3 aa, Artificial Sequence
  Description of Artificial Sequence: Synthetic peptide
DNN

SEQ ID NO: 1173 - protein, 3 aa, Artificial Sequence
  Description of Artificial Sequence: Synthetic peptide
DDD

SEQ ID NO: 1174 - protein, 3 aa, Artificial Sequence
  Description of Artificial Sequence: Synthetic peptide
DNN

SEQ ID NO: 1175 - protein, 3 aa, Artificial Sequence
  Description of Artificial Sequence: Synthetic peptide
DNN

SEQ ID NO: 1176 - protein, 3 aa, Artificial Sequence
  Description of Artificial Sequence: Synthetic peptide
DND

SEQ ID NO: 1177 - protein, 3 aa, Artificial Sequence
  Description of Artificial Sequence: Synthetic peptide
DNN

SEQ ID NO: 1178 - protein, 3 aa, Artificial Sequence
  Description of Artificial Sequence: Synthetic peptide
DTN

SEQ ID NO: 1179 - protein, 3 aa, Artificial Sequence
  Description of Artificial Sequence: Synthetic peptide
DND

SEQ ID NO: 1180 - protein, 3 aa, Artificial Sequence
  Description of Artificial Sequence: Synthetic peptide
DNN

SEQ ID NO: 1181 - protein, 3 aa, Artificial Sequence
  Description of Artificial Sequence: Synthetic peptide
DNN

SEQ ID NO: 1182 - protein, 3 aa, Artificial Sequence
  Description of Artificial Sequence: Synthetic peptide
DTN

SEQ ID NO: 1183 - protein, 3 aa, Artificial Sequence
  Description of Artificial Sequence: Synthetic peptide
DNN

SEQ ID NO: 1184 - protein, 3 aa, Artificial Sequence
  Description of Artificial Sequence: Synthetic peptide
GDD

SEQ ID NO: 1185 - protein, 3 aa, Artificial Sequence
  Description of Artificial Sequence: Synthetic peptide
DNN

SEQ ID NO: 1186 - protein, 3 aa, Artificial Sequence
  Description of Artificial Sequence: Synthetic peptide
DNN

SEQ ID NO: 1187 - protein, 3 aa, Artificial Sequence
  Description of Artificial Sequence: Synthetic peptide
EDN

SEQ ID NO: 1188 - protein, 3 aa, Artificial Sequence
  Description of Artificial Sequence: Synthetic peptide
DNN

SEQ ID NO: 1189 - protein, 3 aa, Artificial Sequence
  Description of Artificial Sequence: Synthetic peptide
DDK

SEQ ID NO: 1190 - protein, 3 aa, Artificial Sequence
  Description of Artificial Sequence: Synthetic peptide
DND

SEQ ID NO: 1191 - protein, 3 aa, Artificial Sequence
  Description of Artificial Sequence: Synthetic peptide
DDD

SEQ ID NO: 1192 - protein, 3 aa, Artificial Sequence
  Description of Artificial Sequence: Synthetic peptide
ENN

SEQ ID NO: 1193 - protein, 3 aa, Artificial Sequence
  Description of Artificial Sequence: Synthetic peptide
DNN

SEQ ID NO: 1194 - protein, 3 aa, Artificial Sequence
  Description of Artificial Sequence: Synthetic peptide
ENK

SEQ ID NO: 1195 - protein, 3 aa, Artificial Sequence
  Description of Artificial Sequence: Synthetic peptide
DNN

SEQ ID NO: 1196 - protein, 3 aa, Artificial Sequence
  Description of Artificial Sequence: Synthetic peptide
ENN

SEQ ID NO: 1197 - protein, 3 aa, Artificial Sequence
  Description of Artificial Sequence: Synthetic peptide
ENN

SEQ ID NO: 1198 - protein, 3 aa, Artificial Sequence
  Description of Artificial Sequence: Synthetic peptide
DTD

SEQ ID NO: 1199 - protein, 3 aa, Artificial Sequence
  Description of Artificial Sequence: Synthetic peptide
DTN

SEQ ID NO: 1200 - protein, 3 aa, Artificial Sequence
  Description of Artificial Sequence: Synthetic peptide
ENV

SEQ ID NO: 1201 - protein, 3 aa, Artificial Sequence
  Description of Artificial Sequence: Synthetic peptide
DNN

SEQ ID NO: 1202 - protein, 3 aa, Artificial Sequence
  Description of Artificial Sequence: Synthetic peptide
ETN

SEQ ID NO: 1203 - protein, 3 aa, Artificial Sequence
  Description of Artificial Sequence: Synthetic peptide
DTN

SEQ ID NO: 1204 - protein, 3 aa, Artificial Sequence
  Description of Artificial Sequence: Synthetic peptide
DNN

SEQ ID NO: 1205 - protein, 3 aa, Artificial Sequence
  Description of Artificial Sequence: Synthetic peptide
DNY

SEQ ID NO: 1206 - protein, 3 aa, Artificial Sequence
  Description of Artificial Sequence: Synthetic peptide
VND

SEQ ID NO: 1207 - protein, 3 aa, Artificial Sequence
  Description of Artificial Sequence: Synthetic peptide
DVD

SEQ ID NO: 1208 - protein, 3 aa, Artificial Sequence
  Description of Artificial Sequence: Synthetic peptide
DNN

SEQ ID NO: 1209 - protein, 3 aa, Artificial Sequence
  Description of Artificial Sequence: Synthetic peptide
DNN

SEQ ID NO: 1210 - protein, 3 aa, Artificial Sequence
  Description of Artificial Sequence: Synthetic peptide
DDD

SEQ ID NO: 1211 - protein, 3 aa, Artificial Sequence
  Description of Artificial Sequence: Synthetic peptide
DNN

SEQ ID NO: 1212 - protein, 3 aa, Artificial Sequence
  Description of Artificial Sequence: Synthetic peptide
DNN

SEQ ID NO: 1213 - protein, 3 aa, Artificial Sequence
  Description of Artificial Sequence: Synthetic peptide
DHN

SEQ ID NO: 1214 - protein, 3 aa, Artificial Sequence
  Description of Artificial Sequence: Synthetic peptide
DNN

SEQ ID NO: 1215 - protein, 3 aa, Artificial Sequence
  Description of Artificial Sequence: Synthetic peptide
DND

SEQ ID NO: 1216 - protein, 3 aa, Artificial Sequence
  Description of Artificial Sequence: Synthetic peptide
ENN

SEQ ID NO: 1217 - protein, 3 aa, Artificial Sequence
  Description of Artificial Sequence: Synthetic peptide
ENT

SEQ ID NO: 1218 - protein, 3 aa, Artificial Sequence
  Description of Artificial Sequence: Synthetic peptide
DND

SEQ ID NO: 1219 - protein, 3 aa, Artificial Sequence
  Description of Artificial Sequence: Synthetic peptide
DTN

SEQ ID NO: 1220 - protein, 3 aa, Artificial Sequence
  Description of Artificial Sequence: Synthetic peptide
DND

SEQ ID NO: 1221 - protein, 3 aa, Artificial Sequence
  Description of Artificial Sequence: Synthetic peptide
EDN

SEQ ID NO: 1222 - protein, 3 aa, Artificial Sequence
  Description of Artificial Sequence: Synthetic peptide
DDN

SEQ ID NO: 1223 - protein, 3 aa, Artificial Sequence
  Description of Artificial Sequence: Synthetic peptide
DKN

SEQ ID NO: 1224 - protein, 3 aa, Artificial Sequence
  Description of Artificial Sequence: Synthetic peptide
DDD

SEQ ID NO: 1225 - protein, 3 aa, Artificial Sequence
  Description of Artificial Sequence: Synthetic peptide
DNN

SEQ ID NO: 1226 - protein, 3 aa, Artificial Sequence
  Description of Artificial Sequence: Synthetic peptide
ENI

SEQ ID NO: 1227 - protein, 3 aa, Artificial Sequence
  Description of Artificial Sequence: Synthetic peptide
DNN

SEQ ID NO: 1228 - protein, 3 aa, Artificial Sequence
  Description of Artificial Sequence: Synthetic peptide
ENR

SEQ ID NO: 1229 - protein, 3 aa, Artificial Sequence
  Description of Artificial Sequence: Synthetic peptide
END

SEQ ID NO: 1230 - protein, 3 aa, Artificial Sequence
  Description of Artificial Sequence: Synthetic peptide
NDN

SEQ ID NO: 1231 - protein, 3 aa, Artificial Sequence
  Description of Artificial Sequence: Synthetic peptide
DNY

SEQ ID NO: 1232 - protein, 3 aa, Artificial Sequence
  Description of Artificial Sequence: Synthetic peptide
ENT

SEQ ID NO: 1233 - protein, 3 aa, Artificial Sequence
  Description of Artificial Sequence: Synthetic peptide
END

SEQ ID NO: 1234 - protein, 3 aa, Artificial Sequence
  Description of Artificial Sequence: Synthetic peptide
DTN

SEQ ID NO: 1235 - protein, 3 aa, Artificial Sequence
  Description of Artificial Sequence: Synthetic peptide
ANN

SEQ ID NO: 1236 - protein, 3 aa, Artificial Sequence
  Description of Artificial Sequence: Synthetic peptide
DKN

SEQ ID NO: 1237 - protein, 3 aa, Artificial Sequence
  Description of Artificial Sequence: Synthetic peptide
ENN

SEQ ID NO: 1238 - protein, 3 aa, Artificial Sequence
  Description of Artificial Sequence: Synthetic peptide
NNN

SEQ ID NO: 1239 - protein, 3 aa, Artificial Sequence
  Description of Artificial Sequence: Synthetic peptide
ANN

SEQ ID NO: 1240 - protein, 3 aa, Artificial Sequence
  Description of Artificial Sequence: Synthetic peptide
DNN

SEQ ID NO: 1241 - protein, 3 aa, Artificial Sequence
  Description of Artificial Sequence: Synthetic peptide
ENT

SEQ ID NO: 1242 - protein, 3 aa, Artificial Sequence
  Description of Artificial Sequence: Synthetic peptide
QNN

SEQ ID NO: 1243 - protein, 3 aa, Artificial Sequence
  Description of Artificial Sequence: Synthetic peptide
GSN

SEQ ID NO: 1244 - protein, 3 aa, Artificial Sequence
  Description of Artificial Sequence: Synthetic peptide
GNN

SEQ ID NO: 1245 - protein, 3 aa, Artificial Sequence
  Description of Artificial Sequence: Synthetic peptide
DND

SEQ ID NO: 1246 - protein, 3 aa, Artificial Sequence
  Description of Artificial Sequence: Synthetic peptide
GDD

SEQ ID NO: 1247 - protein, 3 aa, Artificial Sequence
  Description of Artificial Sequence: Synthetic peptide
AND

SEQ ID NO: 1248 - protein, 3 aa, Artificial Sequence
  Description of Artificial Sequence: Synthetic peptide
DNN

SEQ ID NO: 1249 - protein, 3 aa, Artificial Sequence
  Description of Artificial Sequence: Synthetic peptide
DFN

SEQ ID NO: 1250 - protein, 3 aa, Artificial Sequence
  Description of Artificial Sequence: Synthetic peptide
ENT

SEQ ID NO: 1251 - protein, 3 aa, Artificial Sequence
  Description of Artificial Sequence: Synthetic peptide
DNN

SEQ ID NO: 1252 - protein, 3 aa, Artificial Sequence
  Description of Artificial Sequence: Synthetic peptide
DNN

SEQ ID NO: 1253 - protein, 3 aa, Artificial Sequence
  Description of Artificial Sequence: Synthetic peptide
DNN

SEQ ID NO: 1254 - protein, 3 aa, Artificial Sequence
  Description of Artificial Sequence: Synthetic peptide
DDD

SEQ ID NO: 1255 - protein, 3 aa, Artificial Sequence
  Description of Artificial Sequence: Synthetic peptide
DNN

SEQ ID NO: 1256 - protein, 3 aa, Artificial Sequence
  Description of Artificial Sequence: Synthetic peptide
DNN

SEQ ID NO: 1257 - protein, 3 aa, Artificial Sequence
  Description of Artificial Sequence: Synthetic peptide
DND

SEQ ID NO: 1258 - protein, 3 aa, Artificial Sequence
  Description of Artificial Sequence: Synthetic peptide
DNN

SEQ ID NO: 1259 - protein, 3 aa, Artificial Sequence
  Description of Artificial Sequence: Synthetic peptide
DNN

SEQ ID NO: 1260 - protein, 3 aa, Artificial Sequence
  Description of Artificial Sequence: Synthetic peptide
DDN

SEQ ID NO: 1261 - protein, 3 aa, Artificial Sequence
  Description of Artificial Sequence: Synthetic peptide
ENN

SEQ ID NO: 1262 - protein, 3 aa, Artificial Sequence
  Description of Artificial Sequence: Synthetic peptide
ENN

SEQ ID NO: 1263 - protein, 3 aa, Artificial Sequence
  Description of Artificial Sequence: Synthetic peptide
DNN

SEQ ID NO: 1264 - protein, 3 aa, Artificial Sequence
  Description of Artificial Sequence: Synthetic peptide
DEN

SEQ ID NO: 1265 - protein, 3 aa, Artificial Sequence
  Description of Artificial Sequence: Synthetic peptide
DNN

SEQ ID NO: 1266 - protein, 3 aa, Artificial Sequence
  Description of Artificial Sequence: Synthetic peptide
ENN

SEQ ID NO: 1267 - protein, 3 aa, Artificial Sequence
  Description of Artificial Sequence: Synthetic peptide
DDN

SEQ ID NO: 1268 - protein, 3 aa, Artificial Sequence
  Description of Artificial Sequence: Synthetic peptide
DNN

SEQ ID NO: 1269 - protein, 3 aa, Artificial Sequence
  Description of Artificial Sequence: Synthetic peptide
END

SEQ ID NO: 1270 - protein, 3 aa, Artificial Sequence
  Description of Artificial Sequence: Synthetic peptide
ENT

SEQ ID NO: 1271 - protein, 3 aa, Artificial Sequence
  Description of Artificial Sequence: Synthetic peptide
DNN

SEQ ID NO: 1272 - protein, 3 aa, Artificial Sequence
  Description of Artificial Sequence: Synthetic peptide
ENN

SEQ ID NO: 1273 - protein, 3 aa, Artificial Sequence
  Description of Artificial Sequence: Synthetic peptide
DND

SEQ ID NO: 1274 - protein, 3 aa, Artificial Sequence
  Description of Artificial Sequence: Synthetic peptide
DNN

SEQ ID NO: 1275 - protein, 3 aa, Artificial Sequence
  Description of Artificial Sequence: Synthetic peptide
DNN

SEQ ID NO: 1276 - protein, 3 aa, Artificial Sequence
  Description of Artificial Sequence: Synthetic peptide
DTN

SEQ ID NO: 1277 - protein, 3 aa, Artificial Sequence
  Description of Artificial Sequence: Synthetic peptide
DTN

SEQ ID NO: 1278 - protein, 3 aa, Artificial Sequence
  Description of Artificial Sequence: Synthetic peptide
DND

SEQ ID NO: 1279 - protein, 3 aa, Artificial Sequence
  Description of Artificial Sequence: Synthetic peptide
DNN

SEQ ID NO: 1280 - protein, 3 aa, Artificial Sequence
  Description of Artificial Sequence: Synthetic peptide
DTY

SEQ ID NO: 1281 - protein, 3 aa, Artificial Sequence
  Description of Artificial Sequence: Synthetic peptide
DDN

SEQ ID NO: 1282 - protein, 3 aa, Artificial Sequence
  Description of Artificial Sequence: Synthetic peptide
DNN

SEQ ID NO: 1283 - protein, 3 aa, Artificial Sequence
  Description of Artificial Sequence: Synthetic peptide
DND

SEQ ID NO: 1284 - protein, 3 aa, Artificial Sequence
  Description of Artificial Sequence: Synthetic peptide
DNN

SEQ ID NO: 1285 - protein, 3 aa, Artificial Sequence
  Description of Artificial Sequence: Synthetic peptide
DNN

SEQ ID NO: 1286 - protein, 3 aa, Artificial Sequence
  Description of Artificial Sequence: Synthetic peptide
EDN

SEQ ID NO: 1287 - protein, 3 aa, Artificial Sequence
  Description of Artificial Sequence: Synthetic peptide
DNN

SEQ ID NO: 1288 - protein, 3 aa, Artificial Sequence
  Description of Artificial Sequence: Synthetic peptide
DND

SEQ ID NO: 1289 - protein, 3 aa, Artificial Sequence
  Description of Artificial Sequence: Synthetic peptide
DTY

SEQ ID NO: 1290 - protein, 3 aa, Artificial Sequence
  Description of Artificial Sequence: Synthetic peptide
ENN

SEQ ID NO: 1291 - protein, 3 aa, Artificial Sequence
  Description of Artificial Sequence: Synthetic peptide
DNN

SEQ ID NO: 1292 - protein, 3 aa, Artificial Sequence
  Description of Artificial Sequence: Synthetic peptide
DDN

SEQ ID NO: 1293 - protein, 3 aa, Artificial Sequence
  Description of Artificial Sequence: Synthetic peptide
DNN

SEQ ID NO: 1294 - protein, 3 aa, Artificial Sequence
  Description of Artificial Sequence: Synthetic peptide
DTN

SEQ ID NO: 1295 - protein, 3 aa, Artificial Sequence
  Description of Artificial Sequence: Synthetic peptide
DNN

SEQ ID NO: 1296 - protein, 3 aa, Artificial Sequence
  Description of Artificial Sequence: Synthetic peptide
ENN

SEQ ID NO: 1297 - protein, 3 aa, Artificial Sequence
  Description of Artificial Sequence: Synthetic peptide
ENR

SEQ ID NO: 1298 - protein, 3 aa, Artificial Sequence
  Description of Artificial Sequence: Synthetic peptide
ANN

SEQ ID NO: 1299 - protein, 3 aa, Artificial Sequence
  Description of Artificial Sequence: Synthetic peptide
ENK

SEQ ID NO: 1300 - protein, 3 aa, Artificial Sequence
  Description of Artificial Sequence: Synthetic peptide
DTN

SEQ ID NO: 1301 - protein, 3 aa, Artificial Sequence
  Description of Artificial Sequence: Synthetic peptide
ENR

SEQ ID NO: 1302 - protein, 3 aa, Artificial Sequence
  Description of Artificial Sequence: Synthetic peptide
DTN

SEQ ID NO: 1303 - protein, 3 aa, Artificial Sequence
  Description of Artificial Sequence: Synthetic peptide
DNN

SEQ ID NO: 1304 - protein, 3 aa, Artificial Sequence
  Description of Artificial Sequence: Synthetic peptide
DNN

SEQ ID NO: 1305 - protein, 3 aa, Artificial Sequence
  Description of Artificial Sequence: Synthetic peptide
DNN

SEQ ID NO: 1306 - protein, 3 aa, Artificial Sequence
  Description of Artificial Sequence: Synthetic peptide
DND

SEQ ID NO: 1307 - protein, 3 aa, Artificial Sequence
  Description of Artificial Sequence: Synthetic peptide
NNN

SEQ ID NO: 1308 - protein, 3 aa, Artificial Sequence
  Description of Artificial Sequence: Synthetic peptide
DTY

SEQ ID NO: 1309 - protein, 3 aa, Artificial Sequence
  Description of Artificial Sequence: Synthetic peptide
ANN

SEQ ID NO: 1310 - protein, 3 aa, Artificial Sequence
  Description of Artificial Sequence: Synthetic peptide
END

SEQ ID NO: 1311 - protein, 3 aa, Artificial Sequence
  Description of Artificial Sequence: Synthetic peptide
DND

SEQ ID NO: 1312 - protein, 3 aa, Artificial Sequence
  Description of Artificial Sequence: Synthetic peptide
DTN

SEQ ID NO: 1313 - protein, 3 aa, Artificial Sequence
  Description of Artificial Sequence: Synthetic peptide
DDN

SEQ ID NO: 1314 - protein, 3 aa, Artificial Sequence
  Description of Artificial Sequence: Synthetic peptide
DNN

SEQ ID NO: 1315 - protein, 3 aa, Artificial Sequence
  Description of Artificial Sequence: Synthetic peptide
DDY

SEQ ID NO: 1316 - protein, 3 aa, Artificial Sequence
  Description of Artificial Sequence: Synthetic peptide
DNY

SEQ ID NO: 1317 - protein, 3 aa, Artificial Sequence
  Description of Artificial Sequence: Synthetic peptide
DNN

SEQ ID NO: 1318 - protein, 3 aa, Artificial Sequence
  Description of Artificial Sequence: Synthetic peptide
DNN

SEQ ID NO: 1319 - protein, 3 aa, Artificial Sequence
  Description of Artificial Sequence: Synthetic peptide
ENN

SEQ ID NO: 1320 - protein, 3 aa, Artificial Sequence
  Description of Artificial Sequence: Synthetic peptide
DND

SEQ ID NO: 1321 - protein, 3 aa, Artificial Sequence
  Description of Artificial Sequence: Synthetic peptide
ENN

SEQ ID NO: 1322 - protein, 3 aa, Artificial Sequence
  Description of Artificial Sequence: Synthetic peptide
ASN

SEQ ID NO: 1323 - protein, 3 aa, Artificial Sequence
  Description of Artificial Sequence: Synthetic peptide
ETN

SEQ ID NO: 1324 - protein, 3 aa, Artificial Sequence
  Description of Artificial Sequence: Synthetic peptide
ADN

SEQ ID NO: 1325 - protein, 3 aa, Artificial Sequence
  Description of Artificial Sequence: Synthetic peptide
GNN

SEQ ID NO: 1326 - protein, 3 aa, Artificial Sequence
  Description of Artificial Sequence: Synthetic peptide
DND

SEQ ID NO: 1327 - protein, 3 aa, Artificial Sequence
  Description of Artificial Sequence: Synthetic peptide
DFN

SEQ ID NO: 1328 - protein, 3 aa, Artificial Sequence
  Description of Artificial Sequence: Synthetic peptide
ENK

SEQ ID NO: 1329 - protein, 3 aa, Artificial Sequence
  Description of Artificial Sequence: Synthetic peptide
ENN

SEQ ID NO: 1330 - protein, 3 aa, Artificial Sequence
  Description of Artificial Sequence: Synthetic peptide
DNN

SEQ ID NO: 1331 - protein, 3 aa, Artificial Sequence
  Description of Artificial Sequence: Synthetic peptide
ENN

SEQ ID NO: 1332 - protein, 3 aa, Artificial Sequence
  Description of Artificial Sequence: Synthetic peptide
NNN

SEQ ID NO: 1333 - protein, 3 aa, Artificial Sequence
  Description of Artificial Sequence: Synthetic peptide
GND

SEQ ID NO: 1334 - protein, 3 aa, Artificial Sequence
  Description of Artificial Sequence: Synthetic peptide
DNN

SEQ ID NO: 1335 - protein, 3 aa, Artificial Sequence
  Description of Artificial Sequence: Synthetic peptide
ENK

SEQ ID NO: 1336 - protein, 11 aa, Artificial Sequence
  Description of Artificial Sequence: Synthetic peptide
GTWDNYLGAGV

SEQ ID NO: 1337 - protein, 11 aa, Artificial Sequence
  Description of Artificial Sequence: Synthetic peptide
GTWDTSLSAGA

SEQ ID NO: 1338 - protein, 11 aa, Artificial Sequence
  Description of Artificial Sequence: Synthetic peptide
GTWDTSLSNYV

SEQ ID NO: 1339 - protein, 11 aa, Artificial Sequence
  Description of Artificial Sequence: Synthetic peptide
ATWDATLNTGV

SEQ ID NO: 1340 - protein, 11 aa, Artificial Sequence
  Description of Artificial Sequence: Synthetic peptide
ATWDTSLNVGV

SEQ ID NO: 1341 - protein, 11 aa, Artificial Sequence
  Description of Artificial Sequence: Synthetic peptide
LTWDHSLTAYV

SEQ ID NO: 1342 - protein, 11 aa, Artificial Sequence
  Description of Artificial Sequence: Synthetic peptide
GTWDTSLSVGM

SEQ ID NO: 1343 - protein, 11 aa, Artificial Sequence
  Description of Artificial Sequence: Synthetic peptide
ATWDRGLSTGV

SEQ ID NO: 1344 - protein, 11 aa, Artificial Sequence
  Description of Artificial Sequence: Synthetic peptide
GIWDRSLSAWV

SEQ ID NO: 1345 - protein, 11 aa, Artificial Sequence
  Description of Artificial Sequence: Synthetic peptide
GTWDVSLSVGM

SEQ ID NO: 1346 - protein, 11 aa, Artificial Sequence
  Description of Artificial Sequence: Synthetic peptide
GTWDTSLSVGE

SEQ ID NO: 1347 - protein, 11 aa, Artificial Sequence
  Description of Artificial Sequence: Synthetic peptide
GTWDVTLHTGV

SEQ ID NO: 1348 - DNA, 62 bp, Artificial Sequence
  Description of Artificial Sequence: Synthetic oligonucleotide
  modified_base (51)..(52): Thymidine-succinyl hexamide CED phosphoramidite
agacaatcaaccatttggggtggacagccttgacctctagacttcggcattttttttttttt

SEQ ID NO: 1349 - DNA, 112 bp, Artificial Sequence
  Description of Artificial Sequence: Synthetic polynucleotide
  modified_base (101)..(102): Thymidine-succinyl hexamide CED phosphoramidite
cgggatccttatcgtcatcgtcgtacagatcccgacccatttgctgtccaccagtcatgctagccataccatgatgatgatgatgatgagaaccccgcattttttttttttt

SEQ ID NO: 1350 - DNA, 19 bp, Artificial Sequence
  Description of Artificial Sequence: Synthetic primer
atgcggggttctcatcatc

SEQ ID NO: 1351 - DNA, 20 bp, Artificial Sequence
  Description of Artificial Sequence: Synthetic primer
cgggatccttatcgtcatcg

SEQ ID NO: 1352 - protein, 440 aa, Unknown
  Description of Unknown: GLP1R sequence
RPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 1353 - protein, 11 aa, Artificial Sequence
  Description of Artificial Sequence: Synthetic peptide
GTWDRSLNVGV

SEQ ID NO: 1354 - protein, 11 aa, Artificial Sequence
  Description of Artificial Sequence: Synthetic peptide
GTWDRGPNTGV

SEQ ID NO: 1355 - protein, 11 aa, Artificial Sequence
  Description of Artificial Sequence: Synthetic peptide
ATWDHSLRVGV

SEQ ID NO: 1356 - protein, 11 aa, Artificial Sequence
  Description of Artificial Sequence: Synthetic peptide
GTWDTALTAGV

SEQ ID NO: 1357 - protein, 11 aa, Artificial Sequence
  Description of Artificial Sequence: Synthetic peptide
ATWDRGLSTGV

SEQ ID NO: 1358 - protein, 11 aa, Artificial Sequence
  Description of Artificial Sequence: Synthetic peptide
ATWDTSLNVGV

SEQ ID NO: 1359 - protein, 11 aa, Artificial Sequence
  Description of Artificial Sequence: Synthetic peptide
GTWDRSLSSAV

SEQ ID NO: 1360 - protein, 11 aa, Artificial Sequence
  Description of Artificial Sequence: Synthetic peptide
GTWDTSVSAGV

SEQ ID NO: 1361 - protein, 11 aa, Artificial Sequence
  Description of Artificial Sequence: Synthetic peptide
ATWDRTLSIGV

SEQ ID NO: 1362 - protein, 11 aa, Artificial Sequence
  Description of Artificial Sequence: Synthetic peptide
GTWDTTLNIGV

SEQ ID NO: 1363 - protein, 11 aa, Artificial Sequence
  Description of Artificial Sequence: Synthetic peptide
ATWDRSLRAGV

SEQ ID NO: 1364 - protein, 11 aa, Artificial Sequence
  Description of Artificial Sequence: Synthetic peptide
GTWDTSLSTGV

SEQ ID NO: 1365 - protein, 11 aa, Artificial Sequence
  Description of Artificial Sequence: Synthetic peptide
GTWETSLSAGV

SEQ ID NO: 1366 - protein, 11 aa, Artificial Sequence
  Description of Artificial Sequence: Synthetic peptide
GTWVTSLSAGV

SEQ ID NO: 1367 - protein, 11 aa, Artificial Sequence
  Description of Artificial Sequence: Synthetic peptide
GTWDRSLSGEV

SEQ ID NO: 1368 - protein, 11 aa, Artificial Sequence
  Description of Artificial Sequence: Synthetic peptide
ATWDRGLSTGV

SEQ ID NO: 1369 - protein, 11 aa, Artificial Sequence
  Description of Artificial Sequence: Synthetic peptide
ATWDRSLSAVV

SEQ ID NO: 1370 - protein, 11 aa, Artificial Sequence
  Description of Artificial Sequence: Synthetic peptide
GTWDKSLSAVV

SEQ ID NO: 1371 - protein, 11 aa, Artificial Sequence
  Description of Artificial Sequence: Synthetic peptide
GTWDTSLSGGV

SEQ ID NO: 1372 - protein, 11 aa, Artificial Sequence
  Description of Artificial Sequence: Synthetic peptide
GTWDVTLHTGV

SEQ ID NO: 1373 - protein, 11 aa, Artificial Sequence
  Description of Artificial Sequence: Synthetic peptide
GTWDASLSAGL

SEQ ID NO: 1374 - protein, 11 aa, Artificial Sequence
  Description of Artificial Sequence: Synthetic peptide
GTWESSLSAGV

SEQ ID NO: 1375 - protein, 11 aa, Artificial Sequence
  Description of Artificial Sequence: Synthetic peptide
ATWDASLSGGV

SEQ ID NO: 1376 - protein, 11 aa, Artificial Sequence
  Description of Artificial Sequence: Synthetic peptide
ATWDATLNTGV

SEQ ID NO: 1377 - protein, 11 aa, Artificial Sequence
  Description of Artificial Sequence: Synthetic peptide
GTWDVSLNTQV

SEQ ID NO: 1378 - protein, 11 aa, Artificial Sequence
  Description of Artificial Sequence: Synthetic peptide
ATWDATLNTGV

SEQ ID NO: 1379 - protein, 11 aa, Artificial Sequence
  Description of Artificial Sequence: Synthetic peptide
GTWDASLSGVV

SEQ ID NO: 1380 - protein, 11 aa, Artificial Sequence
  Description of Artificial Sequence: Synthetic peptide
GTWDVTLHTGV

SEQ ID NO: 1381 - protein, 11 aa, Artificial Sequence
  Description of Artificial Sequence: Synthetic peptide
GTWDTGLSAGV

SEQ ID NO: 1382 - protein, 11 aa, Artificial Sequence
  Description of Artificial Sequence: Synthetic peptide
ATWDATLNTGV

SEQ ID NO: 1383 - protein, 11 aa, Artificial Sequence
  Description of Artificial Sequence: Synthetic peptide
GTWDTSLSRYV

SEQ ID NO: 1384 - protein, 11 aa, Artificial Sequence
  Description of Artificial Sequence: Synthetic peptide
GTWDTSLSVGV

SEQ ID NO: 1385 - protein, 11 aa, Artificial Sequence
  Description of Artificial Sequence: Synthetic peptide
GAWDRSLSAYV

SEQ ID NO: 1386 - protein, 11 aa, Artificial Sequence
  Description of Artificial Sequence: Synthetic peptide
ATWDRGLSTGV

SEQ ID NO: 1387 - protein, 11 aa, Artificial Sequence
  Description of Artificial Sequence: Synthetic peptide
GTWDTRLSVGV

SEQ ID NO: 1388 - protein, 11 aa, Artificial Sequence
  Description of Artificial Sequence: Synthetic peptide
ATWDRSLRAGV

SEQ ID NO: 1389 - protein, 11 aa, Artificial Sequence
  Description of Artificial Sequence: Synthetic peptide
ATWDTSLNVGV

SEQ ID NO: 1390 - protein, 11 aa, Artificial Sequence
  Description of Artificial Sequence: Synthetic peptide
GTWDTSLATGL

SEQ ID NO: 1391 - protein, 11 aa, Artificial Sequence
  Description of Artificial Sequence: Synthetic peptide
GTWDTSLSAGA

SEQ ID NO: 1392 - protein, 11 aa, Artificial Sequence
  Description of Artificial Sequence: Synthetic peptide
ATWDRTLSIGV

SEQ ID NO: 1393 - protein, 11 aa, Artificial Sequence
  Description of Artificial Sequence: Synthetic peptide
GAWDRSLSAGV

SEQ ID NO: 1394 - protein, 11 aa, Artificial Sequence
  Description of Artificial Sequence: Synthetic peptide
ATWDATLNTGV

SEQ ID NO: 1395 - protein, 11 aa, Artificial Sequence
  Description of Artificial Sequence: Synthetic peptide
GTWDRSLSAAL

SEQ ID NO: 1396 - protein, 11 aa, Artificial Sequence
  Description of Artificial Sequence: Synthetic peptide
ATWDATLNTGV

SEQ ID NO: 1397 - protein, 11 aa, Artificial Sequence
  Description of Artificial Sequence: Synthetic peptide
GTWDKSLSAGV

SEQ ID NO: 1398 - protein, 11 aa, Artificial Sequence
  Description of Artificial Sequence: Synthetic peptide
ATWDRGLSTGV

SEQ ID NO: 1399 - protein, 11 aa, Artificial Sequence
  Description of Artificial Sequence: Synthetic peptide
ATWDTSLSAEV

SEQ ID NO: 1400 - protein, 11 aa, Artificial Sequence
  Description of Artificial Sequence: Synthetic peptide
ATWDRTLSIGV

SEQ ID NO: 1401 - protein, 11 aa, Artificial Sequence
  Description of Artificial Sequence: Synthetic peptide
GTWGSSLSAGL

SEQ ID NO: 1402 - protein, 11 aa, Artificial Sequence
  Description of Artificial Sequence: Synthetic peptide
GAWDRSLSAGV

SEQ ID NO: 1403 - protein, 11 aa, Artificial Sequence
  Description of Artificial Sequence: Synthetic peptide
AAWDDYLSAVV

SEQ ID NO: 1404 - protein, 11 aa, Artificial Sequence
  Description of Artificial Sequence: Synthetic peptide
GTWDRSLNVGV

SEQ ID NO: 1405 - protein, 11 aa, Artificial Sequence
  Description of Artificial Sequence: Synthetic peptide
ATWDRSLRAGV

SEQ ID NO: 1406 - protein, 11 aa, Artificial Sequence
  Description of Artificial Sequence: Synthetic peptide
GTWDASLSVWV

SEQ ID NO: 1407 - protein, 11 aa, Artificial Sequence
  Description of Artificial Sequence: Synthetic peptide
GTWDNYLGAGV

SEQ ID NO: 1408 - protein, 11 aa, Artificial Sequence
  Description of Artificial Sequence: Synthetic peptide
GTWDTSLSAYI

SEQ ID NO: 1409 - protein, 11 aa, Artificial Sequence
  Description of Artificial Sequence: Synthetic peptide
GTWDTSLSVGM

SEQ ID NO: 1410 - protein, 11 aa, Artificial Sequence
  Description of Artificial Sequence: Synthetic peptide
ATWDRGLSTGV

SEQ ID NO: 1411 - protein, 11 aa, Artificial Sequence
  Description of Artificial Sequence: Synthetic peptide
GTWDANLRAGV

SEQ ID NO: 1412 - protein, 11 aa, Artificial Sequence
  Description of Artificial Sequence: Synthetic peptide
ATWDTSLSEGV

SEQ ID NO: 1413 - protein, 11 aa, Artificial Sequence
  Description of Artificial Sequence: Synthetic peptide
ATWDRGLSTGV

SEQ ID NO: 1414 - protein, 11 aa, Artificial Sequence
  Description of Artificial Sequence: Synthetic peptide
GTWDISLSAAV

SEQ ID NO: 1415 - protein, 11 aa, Artificial Sequence
  Description of Artificial Sequence: Synthetic peptide
ATWDTRLSAVV

SEQ ID NO: 1416 - protein, 11 aa, Artificial Sequence
  Description of Artificial Sequence: Synthetic peptide
GTWDASLGAWV

SEQ ID NO: 1417 - protein, 11 aa, Artificial Sequence
  Description of Artificial Sequence: Synthetic peptide
GTWDARLGGAV

SEQ ID NO: 1418 - protein, 11 aa, Artificial Sequence
  Description of Artificial Sequence: Synthetic peptide
GTWDARLGGAV

SEQ ID NO: 1419 - protein, 11 aa, Artificial Sequence
  Description of Artificial Sequence: Synthetic peptide
GTWDNRLSGWV

SEQ ID NO: 1420 - protein, 11 aa, Artificial Sequence
  Description of Artificial Sequence: Synthetic peptide
ATWDATLNTGV

SEQ ID NO: 1421 - protein, 11 aa, Artificial Sequence
  Description of Artificial Sequence: Synthetic peptide
GTWDVSLNTQV

SEQ ID NO: 1422 - protein, 11 aa, Artificial Sequence
  Description of Artificial Sequence: Synthetic peptide
GTWDTSLNIGV

SEQ ID NO: 1423 - protein, 11 aa, Artificial Sequence
  Description of Artificial Sequence: Synthetic peptide
GTWDTSLSGGI

SEQ ID NO: 1424 - protein, 11 aa, Artificial Sequence
  Description of Artificial Sequence: Synthetic peptide
GTWESSLSAGV

SEQ ID NO: 1425 - protein, 11 aa, Artificial Sequence
  Description of Artificial Sequence: Synthetic peptide
GTWDTSLSVGM

SEQ ID NO: 1426 - protein, 11 aa, Artificial Sequence
  Description of Artificial Sequence: Synthetic peptide
GTWDTSLSVGE

SEQ ID NO: 1427 - protein, 11 aa, Artificial Sequence
  Description of Artificial Sequence: Synthetic peptide
VTWDRSLSAGV

SEQ ID NO: 1428 - protein, 11 aa, Artificial Sequence
  Description of Artificial Sequence: Synthetic peptide
GTWDTSLSVGM

SEQ ID NO: 1429 - protein, 11 aa, Artificial Sequence
  Description of Artificial Sequence: Synthetic peptide
GTWDAGLSTGV

SEQ ID NO: 1430 - protein, 11 aa, Artificial Sequence
  Description of Artificial Sequence: Synthetic peptide
GTWDTSLSAGV

SEQ ID NO: 1431 - protein, 11 aa, Artificial Sequence
  Description of Artificial Sequence: Synthetic peptide
ATWDNRLSAGV

SEQ ID NO: 1432 - protein, 11 aa, Artificial Sequence
  Description of Artificial Sequence: Synthetic peptide
GTWDRGPNTGV

SEQ ID NO: 1433 - protein, 11 aa, Artificial Sequence
  Description of Artificial Sequence: Synthetic peptide
GTWDTSLSVGE

SEQ ID NO: 1434 - protein, 11 aa, Artificial Sequence
  Description of Artificial Sequence: Synthetic peptide
GTWDISPSAWV

SEQ ID NO: 1435 - protein, 11 aa, Artificial Sequence
  Description of Artificial Sequence: Synthetic peptide
GTWDESLRSWV

SEQ ID NO: 1436 - protein, 11 aa, Artificial Sequence
  Description of Artificial Sequence: Synthetic peptide
GTWDTSLSVGE

SEQ ID NO: 1437 - protein, 11 aa, Artificial Sequence
  Description of Artificial Sequence: Synthetic peptide
ATWDNKLTSGV

SEQ ID NO: 1438 - protein, 11 aa, Artificial Sequence
  Description of Artificial Sequence: Synthetic peptide
ATWDTSLNVGV

SEQ ID NO: 1439 - protein, 11 aa, Artificial Sequence
  Description of Artificial Sequence: Synthetic peptide
GTWDTSLSAYI

SEQ ID NO: 1440 - protein, 11 aa, Artificial Sequence
  Description of Artificial Sequence: Synthetic peptide
GTWDRGPNTGV

SEQ ID NO: 1441 - protein, 11 aa, Artificial Sequence
  Description of Artificial Sequence: Synthetic peptide
GTWDTSLSAGA

SEQ ID NO: 1442 - protein, 11 aa, Artificial Sequence
  Description of Artificial Sequence: Synthetic peptide
GTWDTSLSVGE

SEQ ID NO: 1443 - protein, 11 aa, Artificial Sequence
  Description of Artificial Sequence: Synthetic peptide
ATWDATLNTGV

SEQ ID NO: 1444 - protein, 11 aa, Artificial Sequence
  Description of Artificial Sequence: Synthetic peptide
GTWDRSLNVGV

SEQ ID NO: 1445 - protein, 11 aa, Artificial Sequence
  Description of Artificial Sequence: Synthetic peptide
GTWDNNLGAGV

SEQ ID NO: 1446 - protein, 11 aa, Artificial Sequence
  Description of Artificial Sequence: Synthetic peptide
GTWDTSLSTGV

SEQ ID NO: 1447 - protein, 11 aa, Artificial Sequence
  Description of Artificial Sequence: Synthetic peptide
GTWDRGPNTGV

SEQ ID NO: 1448 - protein, 11 aa, Artificial Sequence
  Description of Artificial Sequence: Synthetic peptide
GTWDTSLATGL

SEQ ID NO: 1449 - protein, 11 aa, Artificial Sequence
  Description of Artificial Sequence: Synthetic peptide
GTWDTTLSAGV

SEQ ID NO: 1450 - protein, 11 aa, Artificial Sequence
  Description of Artificial Sequence: Synthetic peptide
GTWDASLSAGL

SEQ ID NO: 1451 - protein, 11 aa, Artificial Sequence
  Description of Artificial Sequence: Synthetic peptide
GTWDASLSAGL

SEQ ID NO: 1452 - protein, 11 aa, Artificial Sequence
  Description of Artificial Sequence: Synthetic peptide
GTWDRTLSIGV

SEQ ID NO: 1453 - protein, 11 aa, Artificial Sequence
  Description of Artificial Sequence: Synthetic peptide
GTWDRRLSDVV

SEQ ID NO: 1454 - protein, 11 aa, Artificial Sequence
  Description of Artificial Sequence: Synthetic peptide
GTWDRSLSSAV

SEQ ID NO: 1455 - protein, 11 aa, Artificial Sequence
  Description of Artificial Sequence: Synthetic peptide
GTWDRSLNVGV

SEQ ID NO: 1456 - protein, 11 aa, Artificial Sequence
  Description of Artificial Sequence: Synthetic peptide
GTWDISLSARV

SEQ ID NO: 1457 - protein, 11 aa, Artificial Sequence
  Description of Artificial Sequence: Synthetic peptide
ATWDTSLSAGV

SEQ ID NO: 1458 - protein, 11 aa, Artificial Sequence
  Description of Artificial Sequence: Synthetic peptide
GTWDTSLATGL

SEQ ID NO: 1459 - protein, 11 aa, Artificial Sequence
  Description of Artificial Sequence: Synthetic peptide
GTWDTSVSAGV

SEQ ID NO: 1460 - protein, 11 aa, Artificial Sequence
  Description of Artificial Sequence: Synthetic peptide
GTWDRSLNVGV

SEQ ID NO: 1461 - protein, 11 aa, Artificial Sequence
  Description of Artificial Sequence: Synthetic peptide
GTWHSSLSAGV

SEQ ID NO: 1462 - protein, 11 aa, Artificial Sequence
  Description of Artificial Sequence: Synthetic peptide
GTWDTTLSAGV

SEQ ID NO: 1463 - protein, 11 aa, Artificial Sequence
  Description of Artificial Sequence: Synthetic peptide
GAWDTSLSAVV

SEQ ID NO: 1464 - protein, 11 aa, Artificial Sequence
  Description of Artificial Sequence: Synthetic peptide
GTWDTSLSVGE

SEQ ID NO: 1465 - protein, 11 aa, Artificial Sequence
  Description of Artificial Sequence: Synthetic peptide
GTWDTSLATGL

SEQ ID NO: 1466 - protein, 11 aa, Artificial Sequence
  Description of Artificial Sequence: Synthetic peptide
ATWDRGLSTGV

SEQ ID NO: 1467 - protein, 11 aa, Artificial Sequence
  Description of Artificial Sequence: Synthetic peptide
GTWDRSLSVGL

SEQ ID NO: 1468 - protein, 11 aa, Artificial Sequence
  Description of Artificial Sequence: Synthetic peptide
GTWDAGLSTGV

SEQ ID NO: 1469 - protein, 11 aa, Artificial Sequence
  Description of Artificial Sequence: Synthetic peptide
GTWDTSLSVGE

SEQ ID NO: 1470 - protein, 11 aa, Artificial Sequence
  Description of Artificial Sequence: Synthetic peptide
ATWDRTLSIGV

SEQ ID NO: 1471 - protein, 11 aa, Artificial Sequence
  Description of Artificial Sequence: Synthetic peptide
GIWDRSLSAWV

SEQ ID NO: 1472 - protein, 11 aa, Artificial Sequence
  Description of Artificial Sequence: Synthetic peptide
GTWDTSLATGL

SEQ ID NO: 1473 - protein, 11 aa, Artificial Sequence
  Description of Artificial Sequence: Synthetic peptide
GTWDRGPNTGV

SEQ ID NO: 1474 - protein, 11 aa, Artificial Sequence
  Description of Artificial Sequence: Synthetic peptide
GTWDVSLSVGM

SEQ ID NO: 1475 - protein, 11 aa, Artificial Sequence
  Description of Artificial Sequence: Synthetic peptide
GTWDVSLSVGM

SEQ ID NO: 1476 - protein, 11 aa, Artificial Sequence
  Description of Artificial Sequence: Synthetic peptide
ATWDTSLSEGV

SEQ ID NO: 1477 - protein, 11 aa, Artificial Sequence
  Description of Artificial Sequence: Synthetic peptide
GTWDVTLHAGV

SEQ ID NO: 1478 - protein, 11 aa, Artificial Sequence
  Description of Artificial Sequence: Synthetic peptide
ATWDRSLSAGV

SEQ ID NO: 1479 - protein, 11 aa, Artificial Sequence
  Description of Artificial Sequence: Synthetic peptide
GTWDNNLGAGV

SEQ ID NO: 1480 - protein, 11 aa, Artificial Sequence
  Description of Artificial Sequence: Synthetic peptide
GTWDASLSAGL

SEQ ID NO: 1481 - protein, 11 aa, Artificial Sequence
  Description of Artificial Sequence: Synthetic peptide
GTWDTSLSVGE

SEQ ID NO: 1482 - protein, 11 aa, Artificial Sequence
  Description of Artificial Sequence: Synthetic peptide
ATWDDTLTAGV

SEQ ID NO: 1483 - protein, 11 aa, Artificial Sequence
  Description of Artificial Sequence: Synthetic peptide
GIWDTSLSAWV

SEQ ID NO: 1484 - protein, 11 aa, Artificial Sequence
  Description of Artificial Sequence: Synthetic peptide
GTWDNRLSAGV

SEQ ID NO: 1485 - protein, 11 aa, Artificial Sequence
  Description of Artificial Sequence: Synthetic peptide
GTWDTSLRVVV

SEQ ID NO: 1486 - protein, 11 aa, Artificial Sequence
  Description of Artificial Sequence: Synthetic peptide
GTWESGLSAGV

SEQ ID NO: 1487 - protein, 11 aa, Artificial Sequence
  Description of Artificial Sequence: Synthetic peptide
ATWDHSLRVGV

SEQ ID NO: 1488 - protein, 11 aa, Artificial Sequence
  Description of Artificial Sequence: Synthetic peptide
GTWHSSLSAGV

SEQ ID NO: 1489 - protein, 11 aa, Artificial Sequence
  Description of Artificial Sequence: Synthetic peptide
GTWDTRLSVGV

SEQ ID NO: 1490 - protein, 11 aa, Artificial Sequence
  Description of Artificial Sequence: Synthetic peptide
GTWDTSLTAGV

SEQ ID NO: 1491 - protein, 11 aa, Artificial Sequence
  Description of Artificial Sequence: Synthetic peptide
ATWDATLNTGV

SEQ ID NO: 1492 - protein, 11 aa, Artificial Sequence
  Description of Artificial Sequence: Synthetic peptide
GTWDTSLSVGM

SEQ ID NO: 1493 - protein, 11 aa, Artificial Sequence
  Description of Artificial Sequence: Synthetic peptide
GTWDRGPNTGV

SEQ ID NO: 1494 - protein, 11 aa, Artificial Sequence
  Description of Artificial Sequence: Synthetic peptide
GTWDNRLSGWV

SEQ ID NO: 1495 - protein, 11 aa, Artificial Sequence
  Description of Artificial Sequence: Synthetic peptide
ATWDRGLSTGV

SEQ ID NO: 1496 - protein, 11 aa, Artificial Sequence
  Description of Artificial Sequence: Synthetic peptide
ATWDRSLSAGV

SEQ ID NO: 1497 - protein, 11 aa, Artificial Sequence
  Description of Artificial Sequence: Synthetic peptide
GTWDRRLSAVV

SEQ ID NO: 1498 - protein, 11 aa, Artificial Sequence
  Description of Artificial Sequence: Synthetic peptide
GTWDNYLGAVV

SEQ ID NO: 1499 - protein, 11 aa, Artificial Sequence
  Description of Artificial Sequence: Synthetic peptide
ATWDATLNTGV

SEQ ID NO: 1500 - protein, 11 aa, Artificial Sequence
  Description of Artificial Sequence: Synthetic peptide
GSWDRSLSAVV

SEQ ID NO: 1501 - protein, 11 aa, Artificial Sequence
  Description of Artificial Sequence: Synthetic peptide
ATWDNILSAWV

SEQ ID NO: 1502 - protein, 11 aa, Artificial Sequence
  Description of Artificial Sequence: Synthetic peptide
ATWDRGLSTGV

SEQ ID NO: 1503 - protein, 11 aa, Artificial Sequence
  Description of Artificial Sequence: Synthetic peptide
GTWDRTLSIGV

SEQ ID NO: 1504 - protein, 11 aa, Artificial Sequence
  Description of Artificial Sequence: Synthetic peptide
GTWDASLGAVV

SEQ ID NO: 1505 - protein, 11 aa, Artificial Sequence
  Description of Artificial Sequence: Synthetic peptide
GTWDAGLSTGV

SEQ ID NO: 1506 - protein, 11 aa, Artificial Sequence
  Description of Artificial Sequence: Synthetic peptide
ATWDRSLRAGV

SEQ ID NO: 1507 - protein, 11 aa, Artificial Sequence
  Description of Artificial Sequence: Synthetic peptide
GTWESGLSAGV

SEQ ID NO: 1508 - protein, 11 aa, Artificial Sequence
  Description of Artificial Sequence: Synthetic peptide
ATWDNKLTSGV

SEQ ID NO: 1509 - protein, 11 aa, Artificial Sequence
  Description of Artificial Sequence: Synthetic peptide
ATWDRSLRAGV

SEQ ID NO: 1510 - protein, 11 aa, Artificial Sequence
  Description of Artificial Sequence: Synthetic peptide
GTWDTSLSAGV

SEQ ID NO: 1511 - protein, 11 aa, Artificial Sequence
  Description of Artificial Sequence: Synthetic peptide
ATWDTTLNTGV

SEQ ID NO: 1512 - protein, 11 aa, Artificial Sequence
  Description of Artificial Sequence: Synthetic peptide
ASWDNRLTAVV

SEQ ID NO: 1513 - protein, 11 aa, Artificial Sequence
  Description of Artificial Sequence: Synthetic peptide
ATWDRGLSTGV

SEQ ID NO: 1514 - protein, 11 aa, Artificial Sequence
  Description of Artificial Sequence: Synthetic peptide
ATWDTSLSEGV

SEQ ID NO: 1515 - protein, 11 aa, Artificial Sequence
  Description of Artificial Sequence: Synthetic peptide
GTWDTSLSGGV

SEQ ID NO: 1516 - protein, 11 aa, Artificial Sequence
  Description of Artificial Sequence: Synthetic peptide
ATWDRGLSTGV

SEQ ID NO: 1517 - protein, 11 aa, Artificial Sequence
  Description of Artificial Sequence: Synthetic peptide
GTWDTSLSVGM

SEQ ID NO: 1518 - protein, 11 aa, Artificial Sequence
  Description of Artificial Sequence: Synthetic peptide
GTWDRGPNTGV

SEQ ID NO: 1519 - protein, 11 aa, Artificial Sequence
  Description of Artificial Sequence: Synthetic peptide
GTWDRSLGGWV

SEQ ID NO: 1520 - protein, 15 aa, Artificial Sequence
  Description of Artificial Sequence: Synthetic peptide
GGGGSGGGGSGGGGS

SEQ ID NO: 1521 - DNA, 30 bp, Artificial Sequence
  Description of Artificial Sequence: Synthetic primer
acagaattcattaaagaggagaaattaacc

SEQ ID NO: 1522 - DNA, 20 bp, Artificial Sequence
  Description of Artificial Sequence: Synthetic primer
tgaaccgcctccaccgctag

SEQ ID NO: 1523 - protein, 37 aa, Artificial Sequence
  Description of Artificial Sequence: Synthetic polypeptide
  MOD_RES (15)..(19): Any amino acid
CARDLRELECEEWTXXXXXSRGPCVDPRGVAGSFDVW

SEQ ID NO: 1524 - protein, 26 aa, Artificial Sequence
  Description of Artificial Sequence: Synthetic peptide
  MOD_RES (10)..(14): Any amino acid
CARDMYYDFXXXXXEVVPADDAFDIW

SEQ ID NO: 1525 - protein, 35 aa, Artificial Sequence
  Description of Artificial Sequence: Synthetic polypeptide
  MOD_RES (17)..(21): Any amino acid
CARDGRGSLPRPKGGPXXXXXYDSSEDSGGAFDIW

SEQ ID NO: 1526 - protein, 23 aa, Artificial Sequence
  Description of Artificial Sequence: Synthetic peptide
  MOD_RES (9)..(13): Any amino acid
CARANQHFXXXXXGYHYYGMDVW

SEQ ID NO: 1527 - protein, 25 aa, Artificial Sequence
  Description of Artificial Sequence: Synthetic peptide
  MOD_RES (9)..(13): Any amino acid
CAKHMSMQXXXXXRADLVGDAFDVW

SEQ ID NO: 1528 - protein, 31 aa, Artificial Sequence
  Description of Artificial Sequence: Synthetic polypeptide
HAEGTFTSDVSSYLEGQAAKEFIAWLVKGRG

SEQ ID NO: 1529 - protein, 33 aa, Artificial Sequence
  Description of Artificial Sequence: Synthetic polypeptide
HADGSFSDEMNTILDNLAARDFINWLIQTKITD

SEQ ID NO: 1530 - protein, 68 aa, Artificial Sequence
  Description of Artificial Sequence: Synthetic polypeptide
CARDMYYDFGYFTGMNTILDNLAARDFINWLIQTKITDRGGGSGGSGGSGGSGGSGEVVPADDAFDIW

What is claimed is:

1. An antibody or antibody fragment that binds to glucagon-like peptide-1 receptor (GLP1R) comprising a heavy chain and a light chain, wherein the heavy chain comprises a heavy chain variable region (VH), and the light chain comprises a light chain variable region (VL), wherein:

(a) the VH comprises a CDR-H1 comprising the amino acid sequence of SEQ ID NO: 441, a CDR-H2 comprising the amino acid sequence of SEQ ID NO: 620, and a CDR-H3 comprising the amino acid sequence of SEQ ID NO: 799, and wherein the VL comprises a CDR-L1 comprising the amino acid sequence of SEQ ID NO: 978, a CDR-L2 comprising the amino acid sequence of SEQ ID NO: 1157, and a CDR-L3 comprising the amino acid sequence of SEQ ID NO: 1336;

(b) the VH comprises a CDR-H1 comprising the amino acid sequence of SEQ ID NO: 534, a CDR-H2 comprising the amino acid sequence of SEQ ID NO: 713, and a CDR-H3 comprising the amino acid sequence of SEQ ID NO: 892, and wherein the VL comprises a CDR-L1 comprising the amino acid sequence of SEQ ID NO: 1071, a CDR-L2 comprising the amino acid sequence of SEQ ID NO: 1250, and a CDR-L3 comprising the amino acid sequence of SEQ ID NO: 1429;

(c) the VH comprises a CDR-H1 comprising the amino acid sequence of SEQ ID NO: 561, a CDR-H2 comprising the amino acid sequence of SEQ ID NO: 740, and a CDR-H3 comprising the amino acid sequence of SEQ ID NO: 919, and wherein the VL comprises a CDR-L1 comprising the amino acid sequence of SEQ ID NO: 1098, a CDR-L2 comprising the amino acid sequence of SEQ ID NO: 1277, and a CDR-L3 comprising the amino acid sequence of SEQ ID NO: 1456; or (d) the VH comprises a CDR-H1 comprising the amino acid sequence of SEQ ID NO: 592, a CDR-H2 comprising the amino acid sequence of SEQ ID NO: 771, and a CDR-H3 comprising the amino acid sequence of SEQ ID NO: 950, and wherein the VL comprises a CDR-L1 comprising the amino acid sequence of SEQ ID NO: 1129, a CDR-L2 comprising the amino acid sequence of SEQ ID NO: 1308, and a CDR-L3 comprising the amino acid sequence of SEQ ID NO: 1487.

2. The antibody or antibody fragment of claim 1, wherein the VH comprises a CDR-H1 comprising the amino acid sequence of SEQ ID NO: 441, a CDR-H2 comprising the amino acid sequence of SEQ ID NO: 620, and a CDR-H3 comprising the amino acid sequence of SEQ ID NO: 799, and wherein the VL comprises a CDR-L1 comprising the amino acid sequence of SEQ ID NO: 978, a CDR-L2 comprising the amino acid sequence of SEQ ID NO: 1157, and a CDR-L3 comprising the amino acid sequence of SEQ ID NO: 1336.

3. The antibody or antibody fragment of claim 1, wherein the VH comprises a CDR-H1 comprising the amino acid sequence of SEQ ID NO: 534, a CDR-H2 comprising the amino acid sequence of SEQ ID NO: 713, and a CDR-H3 comprising the amino acid sequence of SEQ ID NO: 892, and wherein the VL comprises a CDR-L1 comprising the amino acid sequence of SEQ ID NO: 1071, a CDR-L2 comprising the amino acid sequence of SEQ ID NO: 1250, and a CDR-L3 comprising the amino acid sequence of SEQ ID NO: 1429.

4. The antibody or antibody fragment of claim 1, wherein the VH comprises an amino acid sequence at least 90% identical to the amino acid sequence of SEQ ID NO: 70.

5. The antibody or antibody fragment of claim 1, wherein the VH comprises the amino acid sequence of SEQ ID NO: 70.

6. The antibody or antibody fragment of claim 1, wherein the VL comprises an amino acid sequence at least 90% identical to the amino acid sequence of SEQ ID NO: 104.

7. The antibody or antibody fragment of claim 1, wherein the VL comprises the amino acid sequence of SEQ ID NO: 104.

8. The antibody or antibody fragment of claim 1, wherein the VH comprises an amino acid sequence at least 90% identical to the amino acid sequence of SEQ ID NO: 70, and wherein the VL comprises an amino acid sequence at least 90% identical to the amino acid sequence of SEQ ID NO: 104.

9. The antibody or antibody fragment of claim 1, wherein the VH comprises the amino acid sequence of SEQ ID NO: 70, and wherein the VL comprises the amino acid sequence of SEQ ID NO: 104.

10. The antibody or antibody fragment of claim 1, wherein the heavy chain comprises the amino acid sequence of SEQ ID NO: 54, and wherein the light chain comprises the amino acid sequence of SEQ ID NO: 89.

11. The antibody or antibody fragment of claim 1, wherein the antibody is a monoclonal antibody, a bi-specific antibody, a multispecific antibody, a grafted antibody, a humanized antibody, a synthetic antibody, a chimeric antibody, a single-chain Fvs (scFv), a single chain antibody, a Fab fragment, a F(ab')2 fragment, a Fv fragment, a single-domain antibody, a diabody, disulfide-linked Fvs (sdFv), an intrabody, or an antigen-binding fragment thereof.

12. The antibody or antibody fragment of claim 1, wherein the antibody or antibody fragment thereof is chimeric or humanized.

13. The antibody or antibody fragment of claim 1, wherein the antibody or antibody fragment has an EC50 less than about 20 nanomolar in a cAMP assay.

14. The antibody or antibody fragment of claim 1, wherein the antibody or antibody fragment is an agonist of GLP1R.

15. The antibody or antibody fragment of claim 1, wherein the antibody or antibody fragment is an antagonist of GLP1R.

16. The antibody or antibody fragment of claim 1, wherein the antibody or antibody fragment is an allosteric modulator of GLP1R.

* * * * *